United States Patent 12,655,188 (COMPOUNDS CONTAINING ONE OR MORE DIBORONATES AND RELATED INSULIN ANALOGS) - sequence listing, part 2

SEQ ID NO: 23701 - protein, 6 aa, synthetic construct
  REGION 1..6: note = Synthetic Construct
KKTHNK

SEQ ID NO: 23702 - protein, 6 aa, synthetic construct
  REGION 1..6: note = Synthetic Construct
KKTHQK

SEQ ID NO: 23703 - protein, 6 aa, synthetic construct
  REGION 1..6: note = Synthetic Construct
KKTHRK

SEQ ID NO: 23704 - protein, 6 aa, synthetic construct
  REGION 1..6: note = Synthetic Construct
KKTHSK

SEQ ID NO: 23705 - protein, 6 aa, synthetic construct
  REGION 1..6: note = Synthetic Construct
KKTHTK

SEQ ID NO: 23706 - protein, 6 aa, synthetic construct
  REGION 1..6: note = Synthetic Construct
KKTHYK

SEQ ID NO: 23707 - protein, 6 aa, synthetic construct
  REGION 1..6: note = Synthetic Construct
KKTIAK

SEQ ID NO: 23708 - protein, 6 aa, synthetic construct
  REGION 1..6: note = Synthetic Construct
KKTIDK

SEQ ID NO: 23709 - protein, 6 aa, synthetic construct
  REGION 1..6: note = Synthetic Construct
KKTIEK

SEQ ID NO: 23710 - protein, 6 aa, synthetic construct
  REGION 1..6: note = Synthetic Construct
KKTIFK

SEQ ID NO: 23711 - protein, 6 aa, synthetic construct
  REGION 1..6: note = Synthetic Construct
KKTIGK

SEQ ID NO: 23712 - protein, 6 aa, synthetic construct
  REGION 1..6: note = Synthetic Construct
KKTIHK

SEQ ID NO: 23713 - protein, 6 aa, synthetic construct
  REGION 1..6: note = Synthetic Construct
KKTIIK

SEQ ID NO: 23714 - protein, 6 aa, synthetic construct
  REGION 1..6: note = Synthetic Construct
KKTILK

SEQ ID NO: 23715 - protein, 6 aa, synthetic construct
  REGION 1..6: note = Synthetic Construct
KKTINK

SEQ ID NO: 23716 - protein, 6 aa, synthetic construct
  REGION 1..6: note = Synthetic Construct
KKTIQK

SEQ ID NO: 23717 - protein, 6 aa, synthetic construct
  REGION 1..6: note = Synthetic Construct
KKTIRK

SEQ ID NO: 23718 - protein, 6 aa, synthetic construct
  REGION 1..6: note = Synthetic Construct
KKTISK

SEQ ID NO: 23719 - protein, 6 aa, synthetic construct
  REGION 1..6: note = Synthetic Construct
KKTITK

SEQ ID NO: 23720 - protein, 6 aa, synthetic construct
  REGION 1..6: note = Synthetic Construct
KKTIYK

SEQ ID NO: 23721 - protein, 6 aa, synthetic construct
  REGION 1..6: note = Synthetic Construct
KKTLAK

SEQ ID NO: 23722 - protein, 6 aa, synthetic construct
  REGION 1..6: note = Synthetic Construct
KKTLDK

SEQ ID NO: 23723 - protein, 6 aa, synthetic construct
  REGION 1..6: note = Synthetic Construct
KKTLEK

SEQ ID NO: 23724 - protein, 6 aa, synthetic construct
  REGION 1..6: note = Synthetic Construct
KKTLFK

SEQ ID NO: 23725 - protein, 6 aa, synthetic construct
  REGION 1..6: note = Synthetic Construct
KKTLGK

SEQ ID NO: 23726 - protein, 6 aa, synthetic construct
  REGION 1..6: note = Synthetic Construct
KKTLHK

SEQ ID NO: 23727 - protein, 6 aa, synthetic construct
  REGION 1..6: note = Synthetic Construct
KKTLIK

SEQ ID NO: 23728 - protein, 6 aa, synthetic construct
  REGION 1..6: note = Synthetic Construct
KKTLLK

SEQ ID NO: 23729 - protein, 6 aa, synthetic construct
  REGION 1..6: note = Synthetic Construct
KKTLNK

SEQ ID NO: 23730 - protein, 6 aa, synthetic construct
  REGION 1..6: note = Synthetic Construct
KKTLQK

SEQ ID NO: 23731 - protein, 6 aa, synthetic construct
  REGION 1..6: note = Synthetic Construct
KKTLRK

SEQ ID NO: 23732 - protein, 6 aa, synthetic construct
  REGION 1..6: note = Synthetic Construct
KKTLSK

SEQ ID NO: 23733 - protein, 6 aa, synthetic construct
  REGION 1..6: note = Synthetic Construct
KKTLTK

SEQ ID NO: 23734 - protein, 6 aa, synthetic construct
  REGION 1..6: note = Synthetic Construct
KKTLYK

SEQ ID NO: 23735 - protein, 6 aa, synthetic construct
  REGION 1..6: note = Synthetic Construct
KKTNAK

SEQ ID NO: 23736 - protein, 6 aa, synthetic construct
  REGION 1..6: note = Synthetic Construct
KKTNDK

SEQ ID NO: 23737 - protein, 6 aa, synthetic construct
  REGION 1..6: note = Synthetic Construct
KKTNEK

SEQ ID NO: 23738 - protein, 6 aa, synthetic construct
  REGION 1..6: note = Synthetic Construct
KKTNFK

SEQ ID NO: 23739 - protein, 6 aa, synthetic construct
  REGION 1..6: note = Synthetic Construct
KKTNGK

SEQ ID NO: 23740 - protein, 6 aa, synthetic construct
  REGION 1..6: note = Synthetic Construct
KKTNHK

SEQ ID NO: 23741 - protein, 6 aa, synthetic construct
  REGION 1..6: note = Synthetic Construct
KKTNIK

SEQ ID NO: 23742 - protein, 6 aa, synthetic construct
  REGION 1..6: note = Synthetic Construct
KKTNLK

SEQ ID NO: 23743 - protein, 6 aa, synthetic construct
  REGION 1..6: note = Synthetic Construct
KKTNNK

SEQ ID NO: 23744 - protein, 6 aa, synthetic construct
  REGION 1..6: note = Synthetic Construct
KKTNQK

SEQ ID NO: 23745 - protein, 6 aa, synthetic construct
  REGION 1..6: note = Synthetic Construct
KKTNRK

SEQ ID NO: 23746 - protein, 6 aa, synthetic construct
  REGION 1..6: note = Synthetic Construct
KKTNSK

SEQ ID NO: 23747 - protein, 6 aa, synthetic construct
  REGION 1..6: note = Synthetic Construct
KKTNTK

SEQ ID NO: 23748 - protein, 6 aa, synthetic construct
  REGION 1..6: note = Synthetic Construct
KKTNYK

SEQ ID NO: 23749 - protein, 6 aa, synthetic construct
  REGION 1..6: note = Synthetic Construct
KKTQAK

SEQ ID NO: 23750 - protein, 6 aa, synthetic construct
  REGION 1..6: note = Synthetic Construct
KKTQDK

SEQ ID NO: 23751 - protein, 6 aa, synthetic construct
  REGION 1..6: note = Synthetic Construct
KKTQEK

SEQ ID NO: 23752 - protein, 6 aa, synthetic construct
  REGION 1..6: note = Synthetic Construct
KKTQFK

SEQ ID NO: 23753 - protein, 6 aa, synthetic construct
  REGION 1..6: note = Synthetic Construct
KKTQGK

SEQ ID NO: 23754 - protein, 6 aa, synthetic construct
  REGION 1..6: note = Synthetic Construct
KKTQHK

SEQ ID NO: 23755 - protein, 6 aa, synthetic construct
  REGION 1..6: note = Synthetic Construct
KKTQIK

SEQ ID NO: 23756 - protein, 6 aa, synthetic construct
  REGION 1..6: note = Synthetic Construct
KKTQLK

SEQ ID NO: 23757 - protein, 6 aa, synthetic construct
  REGION 1..6: note = Synthetic Construct
KKTQNK

SEQ ID NO: 23758 - protein, 6 aa, synthetic construct
  REGION 1..6: note = Synthetic Construct
KKTQQK

SEQ ID NO: 23759 - protein, 6 aa, synthetic construct
  REGION 1..6: note = Synthetic Construct
KKTQRK

SEQ ID NO: 23760 - protein, 6 aa, synthetic construct
  REGION 1..6: note = Synthetic Construct
KKTQSK

SEQ ID NO: 23761 - protein, 6 aa, synthetic construct
  REGION 1..6: note = Synthetic Construct
KKTQTK

SEQ ID NO: 23762 - protein, 6 aa, synthetic construct
  REGION 1..6: note = Synthetic Construct
KKTQYK

SEQ ID NO: 23763 - protein, 6 aa, synthetic construct
  REGION 1..6: note = Synthetic Construct
KKTRAK

SEQ ID NO: 23764 - protein, 6 aa, synthetic construct
  REGION 1..6: note = Synthetic Construct
KKTRDK

SEQ ID NO: 23765 - protein, 6 aa, synthetic construct
  REGION 1..6: note = Synthetic Construct
KKTREK

SEQ ID NO: 23766 - protein, 6 aa, synthetic construct
  REGION 1..6: note = Synthetic Construct
KKTRFK

SEQ ID NO: 23767 - protein, 6 aa, synthetic construct
  REGION 1..6: note = Synthetic Construct
KKTRGK

SEQ ID NO: 23768 - protein, 6 aa, synthetic construct
  REGION 1..6: note = Synthetic Construct
KKTRHK

SEQ ID NO: 23769 - protein, 6 aa, synthetic construct
  REGION 1..6: note = Synthetic Construct
KKTRIK

SEQ ID NO: 23770 - protein, 6 aa, synthetic construct
  REGION 1..6: note = Synthetic Construct
KKTRLK

SEQ ID NO: 23771 - protein, 6 aa, synthetic construct
  REGION 1..6: note = Synthetic Construct
KKTRNK

SEQ ID NO: 23772 - protein, 6 aa, synthetic construct
  REGION 1..6: note = Synthetic Construct
KKTRQK

SEQ ID NO: 23773 - protein, 6 aa, synthetic construct
  REGION 1..6: note = Synthetic Construct
KKTRRK

SEQ ID NO: 23774 - protein, 6 aa, synthetic construct
  REGION 1..6: note = Synthetic Construct
KKTRSK

SEQ ID NO: 23775 - protein, 6 aa, synthetic construct
  REGION 1..6: note = Synthetic Construct
KKTRTK

SEQ ID NO: 23776 - protein, 6 aa, synthetic construct
  REGION 1..6: note = Synthetic Construct
KKTRYK

SEQ ID NO: 23777 - protein, 6 aa, synthetic construct
  REGION 1..6: note = Synthetic Construct
KKTSAK

SEQ ID NO: 23778 - protein, 6 aa, synthetic construct
  REGION 1..6: note = Synthetic Construct
KKTSDK

SEQ ID NO: 23779 - protein, 6 aa, synthetic construct
  REGION 1..6: note = Synthetic Construct
KKTSEK

SEQ ID NO: 23780 - protein, 6 aa, synthetic construct
  REGION 1..6: note = Synthetic Construct
KKTSFK

SEQ ID NO: 23781 - protein, 6 aa, synthetic construct
  REGION 1..6: note = Synthetic Construct
KKTSGK

SEQ ID NO: 23782 - protein, 6 aa, synthetic construct
  REGION 1..6: note = Synthetic Construct
KKTSHK

SEQ ID NO: 23783 - protein, 6 aa, synthetic construct
  REGION 1..6: note = Synthetic Construct
KKTSIK

SEQ ID NO: 23784 - protein, 6 aa, synthetic construct
  REGION 1..6: note = Synthetic Construct
KKTSLK

SEQ ID NO: 23785 - protein, 6 aa, synthetic construct
  REGION 1..6: note = Synthetic Construct
KKTSNK

SEQ ID NO: 23786 - protein, 6 aa, synthetic construct
  REGION 1..6: note = Synthetic Construct
KKTSQK

SEQ ID NO: 23787 - protein, 6 aa, synthetic construct
  REGION 1..6: note = Synthetic Construct
KKTSRK

SEQ ID NO: 23788 - protein, 6 aa, synthetic construct
  REGION 1..6: note = Synthetic Construct
KKTSSK

SEQ ID NO: 23789 - protein, 6 aa, synthetic construct
  REGION 1..6: note = Synthetic Construct
KKTSTK

SEQ ID NO: 23790 - protein, 6 aa, synthetic construct
  REGION 1..6: note = Synthetic Construct
KKTSYK

SEQ ID NO: 23791 - protein, 6 aa, synthetic construct
  REGION 1..6: note = Synthetic Construct
KKTTAK

SEQ ID NO: 23792 - protein, 6 aa, synthetic construct
  REGION 1..6: note = Synthetic Construct
KKTTDK

SEQ ID NO: 23793 - protein, 6 aa, synthetic construct
  REGION 1..6: note = Synthetic Construct
KKTTEK

SEQ ID NO: 23794 - protein, 6 aa, synthetic construct
  REGION 1..6: note = Synthetic Construct
KKTTFK

SEQ ID NO: 23795 - protein, 6 aa, synthetic construct
  REGION 1..6: note = Synthetic Construct
KKTTGK

SEQ ID NO: 23796 - protein, 6 aa, synthetic construct
  REGION 1..6: note = Synthetic Construct
KKTTHK

SEQ ID NO: 23797 - protein, 6 aa, synthetic construct
  REGION 1..6: note = Synthetic Construct
KKTTIK

SEQ ID NO: 23798 - protein, 6 aa, synthetic construct
  REGION 1..6: note = Synthetic Construct
KKTTLK

SEQ ID NO: 23799 - protein, 6 aa, synthetic construct
  REGION 1..6: note = Synthetic Construct
KKTTNK

SEQ ID NO: 23800 - protein, 6 aa, synthetic construct
  REGION 1..6: note = Synthetic Construct
KKTTQK

SEQ ID NO: 23801 - protein, 6 aa, synthetic construct
  REGION 1..6: note = Synthetic Construct
KKTTRK

SEQ ID NO: 23802 - protein, 6 aa, synthetic construct
  REGION 1..6: note = Synthetic Construct
KKTTSK

SEQ ID NO: 23803 - protein, 6 aa, synthetic construct
  REGION 1..6: note = Synthetic Construct
KKTTTK

SEQ ID NO: 23804 - protein, 6 aa, synthetic construct
  REGION 1..6: note = Synthetic Construct
KKTTYK

SEQ ID NO: 23805 - protein, 6 aa, synthetic construct
  REGION 1..6: note = Synthetic Construct
KKTYAK

SEQ ID NO: 23806 - protein, 6 aa, synthetic construct
  REGION 1..6: note = Synthetic Construct
KKTYDK

SEQ ID NO: 23807 - protein, 6 aa, synthetic construct
  REGION 1..6: note = Synthetic Construct
KKTYEK

SEQ ID NO: 23808 - protein, 6 aa, synthetic construct
  REGION 1..6: note = Synthetic Construct
KKTYFK

SEQ ID NO: 23809 - protein, 6 aa, synthetic construct
  REGION 1..6: note = Synthetic Construct
KKTYGK

SEQ ID NO: 23810 - protein, 6 aa, synthetic construct
  REGION 1..6: note = Synthetic Construct
KKTYHK

SEQ ID NO: 23811 - protein, 6 aa, synthetic construct
  REGION 1..6: note = Synthetic Construct
KKTYIK

SEQ ID NO: 23812 - protein, 6 aa, synthetic construct
  REGION 1..6: note = Synthetic Construct
KKTYLK

SEQ ID NO: 23813 - protein, 6 aa, synthetic construct
  REGION 1..6: note = Synthetic Construct
KKTYNK

SEQ ID NO: 23814 - protein, 6 aa, synthetic construct
  REGION 1..6: note = Synthetic Construct
KKTYQK

SEQ ID NO: 23815 - protein, 6 aa, synthetic construct
  REGION 1..6: note = Synthetic Construct
KKTYRK

SEQ ID NO: 23816 - protein, 6 aa, synthetic construct
  REGION 1..6: note = Synthetic Construct
KKTYSK

SEQ ID NO: 23817 - protein, 6 aa, synthetic construct
  REGION 1..6: note = Synthetic Construct
KKTYTK

SEQ ID NO: 23818 - protein, 6 aa, synthetic construct
  REGION 1..6: note = Synthetic Construct
KKTYYK

SEQ ID NO: 23819 - protein, 6 aa, synthetic construct
  REGION 1..6: note = Synthetic Construct
KKYAAK

SEQ ID NO: 23820 - protein, 6 aa, synthetic construct
  REGION 1..6: note = Synthetic Construct
KKYADK

SEQ ID NO: 23821 - protein, 6 aa, synthetic construct
  REGION 1..6: note = Synthetic Construct
KKYAEK

SEQ ID NO: 23822 - protein, 6 aa, synthetic construct
  REGION 1..6: note = Synthetic Construct
KKYAFK

SEQ ID NO: 23823 - protein, 6 aa, synthetic construct
  REGION 1..6: note = Synthetic Construct
KKYAGK

SEQ ID NO: 23824 - protein, 6 aa, synthetic construct
  REGION 1..6: note = Synthetic Construct
KKYAHK

SEQ ID NO: 23825 - protein, 6 aa, synthetic construct
  REGION 1..6: note = Synthetic Construct
KKYAIK

SEQ ID NO: 23826 - protein, 6 aa, synthetic construct
  REGION 1..6: note = Synthetic Construct
KKYALK

SEQ ID NO: 23827 - protein, 6 aa, synthetic construct
  REGION 1..6: note = Synthetic Construct
KKYANK

SEQ ID NO: 23828 - protein, 6 aa, synthetic construct
  REGION 1..6: note = Synthetic Construct
KKYAQK

SEQ ID NO: 23829 - protein, 6 aa, synthetic construct
  REGION 1..6: note = Synthetic Construct
KKYARK

SEQ ID NO: 23830 - protein, 6 aa, synthetic construct
  REGION 1..6: note = Synthetic Construct
KKYASK

SEQ ID NO: 23831 - protein, 6 aa, synthetic construct
  REGION 1..6: note = Synthetic Construct
KKYATK

SEQ ID NO: 23832 - protein, 6 aa, synthetic construct
  REGION 1..6: note = Synthetic Construct
KKYAYK

SEQ ID NO: 23833 - protein, 6 aa, synthetic construct
  REGION 1..6: note = Synthetic Construct
KKYDAK

SEQ ID NO: 23834 - protein, 6 aa, synthetic construct
  REGION 1..6: note = Synthetic Construct
KKYDDK

SEQ ID NO: 23835 - protein, 6 aa, synthetic construct
  REGION 1..6: note = Synthetic Construct
KKYDEK

SEQ ID NO: 23836 - protein, 6 aa, synthetic construct
  REGION 1..6: note = Synthetic Construct
KKYDFK

SEQ ID NO: 23837 - protein, 6 aa, synthetic construct
  REGION 1..6: note = Synthetic Construct
KKYDGK

SEQ ID NO: 23838 - protein, 6 aa, synthetic construct
  REGION 1..6: note = Synthetic Construct
KKYDHK

SEQ ID NO: 23839 - protein, 6 aa, synthetic construct
  REGION 1..6: note = Synthetic Construct
KKYDIK

SEQ ID NO: 23840 - protein, 6 aa, synthetic construct
  REGION 1..6: note = Synthetic Construct
KKYDLK

SEQ ID NO: 23841 - protein, 6 aa, synthetic construct
  REGION 1..6: note = Synthetic Construct
KKYDNK

SEQ ID NO: 23842 - protein, 6 aa, synthetic construct
  REGION 1..6: note = Synthetic Construct
KKYDQK

SEQ ID NO: 23843 - protein, 6 aa, synthetic construct
  REGION 1..6: note = Synthetic Construct
KKYDRK

SEQ ID NO: 23844 - protein, 6 aa, synthetic construct
  REGION 1..6: note = Synthetic Construct
KKYDSK

SEQ ID NO: 23845 - protein, 6 aa, synthetic construct
  REGION 1..6: note = Synthetic Construct
KKYDTK

SEQ ID NO: 23846 - protein, 6 aa, synthetic construct
  REGION 1..6: note = Synthetic Construct
KKYDYK

SEQ ID NO: 23847 - protein, 6 aa, synthetic construct
  REGION 1..6: note = Synthetic Construct
KKYEAK

SEQ ID NO: 23848 - protein, 6 aa, synthetic construct
  REGION 1..6: note = Synthetic Construct
KKYEDK

SEQ ID NO: 23849 - protein, 6 aa, synthetic construct
  REGION 1..6: note = Synthetic Construct
KKYEEK

SEQ ID NO: 23850 - protein, 6 aa, synthetic construct
  REGION 1..6: note = Synthetic Construct
KKYEFK

SEQ ID NO: 23851 - protein, 6 aa, synthetic construct
  REGION 1..6: note = Synthetic Construct
KKYEGK

SEQ ID NO: 23852 - protein, 6 aa, synthetic construct
  REGION 1..6: note = Synthetic Construct
KKYEHK

SEQ ID NO: 23853 - protein, 6 aa, synthetic construct
  REGION 1..6: note = Synthetic Construct
KKYEIK

SEQ ID NO: 23854 - protein, 6 aa, synthetic construct
  REGION 1..6: note = Synthetic Construct
KKYELK

SEQ ID NO: 23855 - protein, 6 aa, synthetic construct
  REGION 1..6: note = Synthetic Construct
KKYENK

SEQ ID NO: 23856 - protein, 6 aa, synthetic construct
  REGION 1..6: note = Synthetic Construct
KKYEQK

SEQ ID NO: 23857 - protein, 6 aa, synthetic construct
  REGION 1..6: note = Synthetic Construct
KKYERK

SEQ ID NO: 23858 - protein, 6 aa, synthetic construct
  REGION 1..6: note = Synthetic Construct
KKYESK

SEQ ID NO: 23859 - protein, 6 aa, synthetic construct
  REGION 1..6: note = Synthetic Construct
KKYETK

SEQ ID NO: 23860 - protein, 6 aa, synthetic construct
  REGION 1..6: note = Synthetic Construct
KKYEYK

SEQ ID NO: 23861 - protein, 6 aa, synthetic construct
  REGION 1..6: note = Synthetic Construct
KKYFAK

SEQ ID NO: 23862 - protein, 6 aa, synthetic construct
  REGION 1..6: note = Synthetic Construct
KKYFDK

SEQ ID NO: 23863 - protein, 6 aa, synthetic construct
  REGION 1..6: note = Synthetic Construct
KKYFEK

SEQ ID NO: 23864 - protein, 6 aa, synthetic construct
  REGION 1..6: note = Synthetic Construct
KKYFFK

SEQ ID NO: 23865 - protein, 6 aa, synthetic construct
  REGION 1..6: note = Synthetic Construct
KKYFGK

SEQ ID NO: 23866 - protein, 6 aa, synthetic construct
  REGION 1..6: note = Synthetic Construct
KKYFHK

SEQ ID NO: 23867 - protein, 6 aa, synthetic construct
  REGION 1..6: note = Synthetic Construct
KKYFIK

SEQ ID NO: 23868 - protein, 6 aa, synthetic construct
  REGION 1..6: note = Synthetic Construct
KKYFLK

SEQ ID NO: 23869 - protein, 6 aa, synthetic construct
  REGION 1..6: note = Synthetic Construct
KKYFNK

SEQ ID NO: 23870 - protein, 6 aa, synthetic construct
  REGION 1..6: note = Synthetic Construct
KKYFQK

SEQ ID NO: 23871 - protein, 6 aa, synthetic construct
  REGION 1..6: note = Synthetic Construct
KKYFRK

SEQ ID NO: 23872 - protein, 6 aa, synthetic construct
  REGION 1..6: note = Synthetic Construct
KKYFSK

SEQ ID NO: 23873 - protein, 6 aa, synthetic construct
  REGION 1..6: note = Synthetic Construct
KKYFTK

SEQ ID NO: 23874 - protein, 6 aa, synthetic construct
  REGION 1..6: note = Synthetic Construct
KKYFYK

SEQ ID NO: 23875 - protein, 6 aa, synthetic construct
  REGION 1..6: note = Synthetic Construct
KKYGAK

SEQ ID NO: 23876 - protein, 6 aa, synthetic construct
  REGION 1..6: note = Synthetic Construct
KKYGDK

SEQ ID NO: 23877 - protein, 6 aa, synthetic construct
  REGION 1..6: note = Synthetic Construct
KKYGEK

SEQ ID NO: 23878 - protein, 6 aa, synthetic construct
  REGION 1..6: note = Synthetic Construct
KKYGFK

SEQ ID NO: 23879 - protein, 6 aa, synthetic construct
  REGION 1..6: note = Synthetic Construct
KKYGGK

SEQ ID NO: 23880 - protein, 6 aa, synthetic construct
  REGION 1..6: note = Synthetic Construct
KKYGHK

SEQ ID NO: 23881 - protein, 6 aa, synthetic construct
  REGION 1..6: note = Synthetic Construct
KKYGIK

SEQ ID NO: 23882 - protein, 6 aa, synthetic construct
  REGION 1..6: note = Synthetic Construct
KKYGLK

SEQ ID NO: 23883 - protein, 6 aa, synthetic construct
  REGION 1..6: note = Synthetic Construct
KKYGNK

SEQ ID NO: 23884 - protein, 6 aa, synthetic construct
  REGION 1..6: note = Synthetic Construct
KKYGQK

SEQ ID NO: 23885 - protein, 6 aa, synthetic construct
  REGION 1..6: note = Synthetic Construct
KKYGRK

SEQ ID NO: 23886 - protein, 6 aa, synthetic construct
  REGION 1..6: note = Synthetic Construct
KKYGSK

SEQ ID NO: 23887 - protein, 6 aa, synthetic construct
  REGION 1..6: note = Synthetic Construct
KKYGTK

SEQ ID NO: 23888 - protein, 6 aa, synthetic construct
  REGION 1..6: note = Synthetic Construct
KKYGYK

SEQ ID NO: 23889 - protein, 6 aa, synthetic construct
  REGION 1..6: note = Synthetic Construct
KKYHAK

SEQ ID NO: 23890 - protein, 6 aa, synthetic construct
  REGION 1..6: note = Synthetic Construct
KKYHDK

SEQ ID NO: 23891 - protein, 6 aa, synthetic construct
  REGION 1..6: note = Synthetic Construct
KKYHEK

SEQ ID NO: 23892 - protein, 6 aa, synthetic construct
  REGION 1..6: note = Synthetic Construct
KKYHFK

SEQ ID NO: 23893 - protein, 6 aa, synthetic construct
  REGION 1..6: note = Synthetic Construct
KKYHGK

SEQ ID NO: 23894 - protein, 6 aa, synthetic construct
  REGION 1..6: note = Synthetic Construct
KKYHHK

SEQ ID NO: 23895 - protein, 6 aa, synthetic construct
  REGION 1..6: note = Synthetic Construct
KKYHIK

SEQ ID NO: 23896 - protein, 6 aa, synthetic construct
  REGION 1..6: note = Synthetic Construct
KKYHLK

SEQ ID NO: 23897 - protein, 6 aa, synthetic construct
  REGION 1..6: note = Synthetic Construct
KKYHNK

SEQ ID NO: 23898 - protein, 6 aa, synthetic construct
  REGION 1..6: note = Synthetic Construct
KKYHQK

SEQ ID NO: 23899 - protein, 6 aa, synthetic construct
  REGION 1..6: note = Synthetic Construct
KKYHRK

SEQ ID NO: 23900 - protein, 6 aa, synthetic construct
  REGION 1..6: note = Synthetic Construct
KKYHSK

SEQ ID NO: 23901 - protein, 6 aa, synthetic construct
  REGION 1..6: note = Synthetic Construct
KKYHTK

SEQ ID NO: 23902 - protein, 6 aa, synthetic construct
  REGION 1..6: note = Synthetic Construct
KKYHYK

SEQ ID NO: 23903 - protein, 6 aa, synthetic construct
  REGION 1..6: note = Synthetic Construct
KKYIAK

SEQ ID NO: 23904 - protein, 6 aa, synthetic construct
  REGION 1..6: note = Synthetic Construct
KKYIDK

SEQ ID NO: 23905 - protein, 6 aa, synthetic construct
  REGION 1..6: note = Synthetic Construct
KKYIEK

SEQ ID NO: 23906 - protein, 6 aa, synthetic construct
  REGION 1..6: note = Synthetic Construct
KKYIFK

SEQ ID NO: 23907 - protein, 6 aa, synthetic construct
  REGION 1..6: note = Synthetic Construct
KKYIGK

SEQ ID NO: 23908 - protein, 6 aa, synthetic construct
  REGION 1..6: note = Synthetic Construct
KKYIHK

SEQ ID NO: 23909 - protein, 6 aa, synthetic construct
  REGION 1..6: note = Synthetic Construct
KKYIIK

SEQ ID NO: 23910 - protein, 6 aa, synthetic construct
  REGION 1..6: note = Synthetic Construct
KKYILK

SEQ ID NO: 23911 - protein, 6 aa, synthetic construct
  REGION 1..6: note = Synthetic Construct
KKYINK

SEQ ID NO: 23912 - protein, 6 aa, synthetic construct
  REGION 1..6: note = Synthetic Construct
KKYIQK

SEQ ID NO: 23913 - protein, 6 aa, synthetic construct
  REGION 1..6: note = Synthetic Construct
KKYIRK

SEQ ID NO: 23914 - protein, 6 aa, synthetic construct
  REGION 1..6: note = Synthetic Construct
KKYISK

SEQ ID NO: 23915 - protein, 6 aa, synthetic construct
  REGION 1..6: note = Synthetic Construct
KKYITK

SEQ ID NO: 23916 - protein, 6 aa, synthetic construct
  REGION 1..6: note = Synthetic Construct
KKYIYK

SEQ ID NO: 23917 - protein, 6 aa, synthetic construct
  REGION 1..6: note = Synthetic Construct
KKYLAK

SEQ ID NO: 23918 - protein, 6 aa, synthetic construct
  REGION 1..6: note = Synthetic Construct
KKYLDK

SEQ ID NO: 23919 - protein, 6 aa, synthetic construct
  REGION 1..6: note = Synthetic Construct
KKYLEK

SEQ ID NO: 23920 - protein, 6 aa, synthetic construct
  REGION 1..6: note = Synthetic Construct
KKYLFK

SEQ ID NO: 23921 - protein, 6 aa, synthetic construct
  REGION 1..6: note = Synthetic Construct
KKYLGK

SEQ ID NO: 23922 - protein, 6 aa, synthetic construct
  REGION 1..6: note = Synthetic Construct
KKYLHK

SEQ ID NO: 23923 - protein, 6 aa, synthetic construct
  REGION 1..6: note = Synthetic Construct
KKYLIK

SEQ ID NO: 23924 - protein, 6 aa, synthetic construct
  REGION 1..6: note = Synthetic Construct
KKYLLK

SEQ ID NO: 23925 - protein, 6 aa, synthetic construct
  REGION 1..6: note = Synthetic Construct
KKYLNK

SEQ ID NO: 23926 - protein, 6 aa, synthetic construct
  REGION 1..6: note = Synthetic Construct
KKYLQK

SEQ ID NO: 23927 - protein, 6 aa, synthetic construct
  REGION 1..6: note = Synthetic Construct
KKYLRK

SEQ ID NO: 23928 - protein, 6 aa, synthetic construct
  REGION 1..6: note = Synthetic Construct
KKYLSK

SEQ ID NO: 23929 - protein, 6 aa, synthetic construct
  REGION 1..6: note = Synthetic Construct
KKYLTK

SEQ ID NO: 23930 - protein, 6 aa, synthetic construct
  REGION 1..6: note = Synthetic Construct
KKYLYK

SEQ ID NO: 23931 - protein, 6 aa, synthetic construct
  REGION 1..6: note = Synthetic Construct
KKYNAK

SEQ ID NO: 23932 - protein, 6 aa, synthetic construct
  REGION 1..6: note = Synthetic Construct
KKYNDK

SEQ ID NO: 23933 - protein, 6 aa, synthetic construct
  REGION 1..6: note = Synthetic Construct
KKYNEK

SEQ ID NO: 23934 - protein, 6 aa, synthetic construct
  REGION 1..6: note = Synthetic Construct
KKYNFK

SEQ ID NO: 23935 - protein, 6 aa, synthetic construct
  REGION 1..6: note = Synthetic Construct
KKYNGK

SEQ ID NO: 23936 - protein, 6 aa, synthetic construct
  REGION 1..6: note = Synthetic Construct
KKYNHK

SEQ ID NO: 23937 - protein, 6 aa, synthetic construct
  REGION 1..6: note = Synthetic Construct
KKYNIK

SEQ ID NO: 23938 - protein, 6 aa, synthetic construct
  REGION 1..6: note = Synthetic Construct
KKYNLK

SEQ ID NO: 23939 - protein, 6 aa, synthetic construct
  REGION 1..6: note = Synthetic Construct
KKYNNK

SEQ ID NO: 23940 - protein, 6 aa, synthetic construct
  REGION 1..6: note = Synthetic Construct
KKYNQK

SEQ ID NO: 23941 - protein, 6 aa, synthetic construct
  REGION 1..6: note = Synthetic Construct
KKYNRK

SEQ ID NO: 23942 - protein, 6 aa, synthetic construct
  REGION 1..6: note = Synthetic Construct
KKYNSK

SEQ ID NO: 23943 - protein, 6 aa, synthetic construct
  REGION 1..6: note = Synthetic Construct
KKYNTK

SEQ ID NO: 23944 - protein, 6 aa, synthetic construct
  REGION 1..6: note = Synthetic Construct
KKYNYK

SEQ ID NO: 23945 - protein, 6 aa, synthetic construct
  REGION 1..6: note = Synthetic Construct
KKYQAK

SEQ ID NO: 23946 - protein, 6 aa, synthetic construct
  REGION 1..6: note = Synthetic Construct
KKYQDK

SEQ ID NO: 23947 - protein, 6 aa, synthetic construct
  REGION 1..6: note = Synthetic Construct
KKYQEK

SEQ ID NO: 23948 - protein, 6 aa, synthetic construct
  REGION 1..6: note = Synthetic Construct
KKYQFK

SEQ ID NO: 23949 - protein, 6 aa, synthetic construct
  REGION 1..6: note = Synthetic Construct
KKYQGK

SEQ ID NO: 23950 - protein, 6 aa, synthetic construct
  REGION 1..6: note = Synthetic Construct
KKYQHK

SEQ ID NO: 23951 - protein, 6 aa, synthetic construct
  REGION 1..6: note = Synthetic Construct
KKYQIK

SEQ ID NO: 23952 - protein, 6 aa, synthetic construct
  REGION 1..6: note = Synthetic Construct
KKYQLK

SEQ ID NO: 23953 - protein, 6 aa, synthetic construct
  REGION 1..6: note = Synthetic Construct
KKYQNK

SEQ ID NO: 23954 - protein, 6 aa, synthetic construct
  REGION 1..6: note = Synthetic Construct
KKYQQK

SEQ ID NO: 23955 - protein, 6 aa, synthetic construct
  REGION 1..6: note = Synthetic Construct
KKYQRK

SEQ ID NO: 23956 - protein, 6 aa, synthetic construct
  REGION 1..6: note = Synthetic Construct
KKYQSK

SEQ ID NO: 23957 - protein, 6 aa, synthetic construct
  REGION 1..6: note = Synthetic Construct
KKYQTK

SEQ ID NO: 23958 - protein, 6 aa, synthetic construct
  REGION 1..6: note = Synthetic Construct
KKYQYK

SEQ ID NO: 23959 - protein, 6 aa, synthetic construct
  REGION 1..6: note = Synthetic Construct
KKYRAK

SEQ ID NO: 23960 - protein, 6 aa, synthetic construct
  REGION 1..6: note = Synthetic Construct
KKYRDK

SEQ ID NO: 23961 - protein, 6 aa, synthetic construct
  REGION 1..6: note = Synthetic Construct
KKYREK

SEQ ID NO: 23962 - protein, 6 aa, synthetic construct
  REGION 1..6: note = Synthetic Construct
KKYRFK

SEQ ID NO: 23963 - protein, 6 aa, synthetic construct
  REGION 1..6: note = Synthetic Construct
KKYRGK

SEQ ID NO: 23964 - protein, 6 aa, synthetic construct
  REGION 1..6: note = Synthetic Construct
KKYRHK

SEQ ID NO: 23965 - protein, 6 aa, synthetic construct
  REGION 1..6: note = Synthetic Construct
KKYRIK

SEQ ID NO: 23966 - protein, 6 aa, synthetic construct
  REGION 1..6: note = Synthetic Construct
KKYRLK

SEQ ID NO: 23967 - protein, 6 aa, synthetic construct
  REGION 1..6: note = Synthetic Construct
KKYRNK

SEQ ID NO: 23968 - protein, 6 aa, synthetic construct
  REGION 1..6: note = Synthetic Construct
KKYRQK

SEQ ID NO: 23969 - protein, 6 aa, synthetic construct
  REGION 1..6: note = Synthetic Construct
KKYRRK

SEQ ID NO: 23970 - protein, 6 aa, synthetic construct
  REGION 1..6: note = Synthetic Construct
KKYRSK

SEQ ID NO: 23971 - protein, 6 aa, synthetic construct
  REGION 1..6: note = Synthetic Construct
KKYRTK

SEQ ID NO: 23972 - protein, 6 aa, synthetic construct
  REGION 1..6: note = Synthetic Construct
KKYRYK

SEQ ID NO: 23973 - protein, 6 aa, synthetic construct
  REGION 1..6: note = Synthetic Construct
KKYSAK

SEQ ID NO: 23974 - protein, 6 aa, synthetic construct
  REGION 1..6: note = Synthetic Construct
KKYSDK

SEQ ID NO: 23975 - protein, 6 aa, synthetic construct
  REGION 1..6: note = Synthetic Construct
KKYSEK

SEQ ID NO: 23976 - protein, 6 aa, synthetic construct
  REGION 1..6: note = Synthetic Construct
KKYSFK

SEQ ID NO: 23977 - protein, 6 aa, synthetic construct
  REGION 1..6: note = Synthetic Construct
KKYSGK

SEQ ID NO: 23978 - protein, 6 aa, synthetic construct
  REGION 1..6: note = Synthetic Construct
KKYSHK

SEQ ID NO: 23979 - protein, 6 aa, synthetic construct
  REGION 1..6: note = Synthetic Construct
KKYSIK

SEQ ID NO: 23980 - protein, 6 aa, synthetic construct
  REGION 1..6: note = Synthetic Construct
KKYSLK

SEQ ID NO: 23981 - protein, 6 aa, synthetic construct
  REGION 1..6: note = Synthetic Construct
KKYSNK

SEQ ID NO: 23982 - protein, 6 aa, synthetic construct
  REGION 1..6: note = Synthetic Construct
KKYSQK

SEQ ID NO: 23983 - protein, 6 aa, synthetic construct
  REGION 1..6: note = Synthetic Construct
KKYSRK

SEQ ID NO: 23984 - protein, 6 aa, synthetic construct
  REGION 1..6: note = Synthetic Construct
KKYSSK

SEQ ID NO: 23985 - protein, 6 aa, synthetic construct
  REGION 1..6: note = Synthetic Construct
KKYSTK

SEQ ID NO: 23986 - protein, 6 aa, synthetic construct
  REGION 1..6: note = Synthetic Construct
KKYSYK

SEQ ID NO: 23987 - protein, 6 aa, synthetic construct
  REGION 1..6: note = Synthetic Construct
KKYTAK

SEQ ID NO: 23988 - protein, 6 aa, synthetic construct
  REGION 1..6: note = Synthetic Construct
KKYTDK

SEQ ID NO: 23989 - protein, 6 aa, synthetic construct
  REGION 1..6: note = Synthetic Construct
KKYTEK

SEQ ID NO: 23990 - protein, 6 aa, synthetic construct
  REGION 1..6: note = Synthetic Construct
KKYTFK

SEQ ID NO: 23991 - protein, 6 aa, synthetic construct
  REGION 1..6: note = Synthetic Construct
KKYTGK

SEQ ID NO: 23992 - protein, 6 aa, synthetic construct
  REGION 1..6: note = Synthetic Construct
KKYTHK

SEQ ID NO: 23993 - protein, 6 aa, synthetic construct
  REGION 1..6: note = Synthetic Construct
KKYTIK

SEQ ID NO: 23994 - protein, 6 aa, synthetic construct
  REGION 1..6: note = Synthetic Construct
KKYTLK

SEQ ID NO: 23995 - protein, 6 aa, synthetic construct
  REGION 1..6: note = Synthetic Construct
KKYTNK

SEQ ID NO: 23996 - protein, 6 aa, synthetic construct
  REGION 1..6: note = Synthetic Construct
KKYTQK

SEQ ID NO: 23997 - protein, 6 aa, synthetic construct
  REGION 1..6: note = Synthetic Construct
KKYTRK

SEQ ID NO: 23998 - protein, 6 aa, synthetic construct
  REGION 1..6: note = Synthetic Construct
KKYTSK

SEQ ID NO: 23999 - protein, 6 aa, synthetic construct
  REGION 1..6: note = Synthetic Construct
KKYTTK

SEQ ID NO: 24000 - protein, 6 aa, synthetic construct
  REGION 1..6: note = Synthetic Construct
KKYTYK

SEQ ID NO: 24001 - protein, 6 aa, synthetic construct
  REGION 1..6: note = Synthetic Construct
KKYYAK

SEQ ID NO: 24002 - protein, 6 aa, synthetic construct
  REGION 1..6: note = Synthetic Construct
KKYYDK

SEQ ID NO: 24003 - protein, 6 aa, synthetic construct
  REGION 1..6: note = Synthetic Construct
KKYYEK

SEQ ID NO: 24004 - protein, 6 aa, synthetic construct
  REGION 1..6: note = Synthetic Construct
KKYYFK

SEQ ID NO: 24005 - protein, 6 aa, synthetic construct
  REGION 1..6: note = Synthetic Construct
KKYYGK

SEQ ID NO: 24006 - protein, 6 aa, synthetic construct
  REGION 1..6: note = Synthetic Construct
KKYYHK

SEQ ID NO: 24007 - protein, 6 aa, synthetic construct
  REGION 1..6: note = Synthetic Construct
KKYYIK

SEQ ID NO: 24008 - protein, 6 aa, synthetic construct
  REGION 1..6: note = Synthetic Construct
KKYYLK

SEQ ID NO: 24009 - protein, 6 aa, synthetic construct
  REGION 1..6: note = Synthetic Construct
KKYYNK

SEQ ID NO: 24010 - protein, 6 aa, synthetic construct
  REGION 1..6: note = Synthetic Construct
KKYYQK

SEQ ID NO: 24011 - protein, 6 aa, synthetic construct
  REGION 1..6: note = Synthetic Construct
KKYYRK

SEQ ID NO: 24012 - protein, 6 aa, synthetic construct
  REGION 1..6: note = Synthetic Construct
KKYYSK

SEQ ID NO: 24013 - protein, 6 aa, synthetic construct
  REGION 1..6: note = Synthetic Construct
KKYYTK

SEQ ID NO: 24014 - protein, 6 aa, synthetic construct
  REGION 1..6: note = Synthetic Construct
KKYYYK

SEQ ID NO: 24015 - protein, 33 aa, synthetic construct
  REGION 1..33: note = Synthetic Construct
  VARIANT 1: note = MISC_FEATURE - Xaa at position 1 is A, D, E, F, G, H, I, K, L, N, P, Q, R, S, T, V, Y, W, or absent
  VARIANT 2: note = MISC_FEATURE - Xaa at position 2 is A, D, E, F, G, H, I, K, L, N, P, Q, R, S, T, V, Y, W, or absent
  VARIANT 3: note = MISC_FEATURE - Xaa at position 3 is A, D, E, F, G, H, I, K, L, N, P, Q, R, S, T, V, Y, W, or absent
  VARIANT 4: note = MISC_FEATURE - Xaa at position 4 is A, D, E, F, G, H, I, K, L, N, P, Q, R, S, T, V, Y, W, or absent
  VARIANT 5: note = MISC_FEATURE - Xaa at position 5 is A, D, E, F, G, H, I, K, L, N, P, Q, R, S, T, V, Y, W, or absent
  VARIANT 6: note = MISC_FEATURE - Xaa at position 6 is A, D, E, F, G, H, I, K, L, N, P, Q, R, S, T, V, Y, W, or absent
  VARIANT 7: note = MISC_FEATURE - Xaa at position 7 is A, D, E, F, G, H, I, K, L, N, P, Q, R, S, T, V, Y, W, or absent
  VARIANT 13: note = MISC_FEATURE - Xaa at position 13 is A, D, E, F, G, H, I, K, L, N, P, Q, R, S, T, V, Y, W, or absent
  VARIANT 14: note = MISC_FEATURE - Xaa at position 14 is A, D, E, F, G, H, I, K, L, N, P, Q, R, S, T, V, Y, W, or absent
  VARIANT 27: note = MISC_FEATURE - Xaa at position 27 is A, D, E, F, G, H, I, K, L, N, P, Q, R, S, T, V, Y, W, or absent
  VARIANT 28: note = MISC_FEATURE - Xaa at position 28 is A, D, E, F, G, H, I, K, L, N, P, Q, R, S, T, V, Y, W, or absent
  VARIANT 29: note = MISC_FEATURE - Xaa at position 29 is A, D, E, F, G, H, I, K, L, N, P, Q, R, S, T, V, Y, W, or absent
  VARIANT 30: note = MISC_FEATURE - Xaa at position 30 is A, D, E, F, G, H, I, K, L, N, P, Q, R, S, T, V, Y, W, or absent
  VARIANT 31: note = MISC_FEATURE - Xaa at position 31 is A, D, E, F, G, H, I, K, L, N, P, Q, R, S, T, V, Y, W, or absent
  VARIANT 32: note = MISC_FEATURE - Xaa at position 32 is A, D, E, F, G, H, I, K, L, N, P, Q, R, S, T, V, Y, W, or absent
  VARIANT 33: note = MISC_FEATURE - Xaa at position 33 is A, D, E, F, G, H, I, K, L, N, P, Q, R, S, T, V, Y, W, or absent
XXXXXXXVEQCCXXICSLYQLENYCNXXXXXXX

SEQ ID NO: 24016 - protein, 46 aa, synthetic construct
  REGION 1..46: note = Synthetic Construct
  VARIANT 1: note = MISC_FEATURE - Xaa at position 1 is A, D, E, F, G, H, I, K, L, N, P, Q, R, S, T, V, Y, W, or absent
  VARIANT 2: note = MISC_FEATURE - Xaa at position 2 is A, D, E, F, G, H, I, K, L, N, P, Q, R, S, T, V, Y, W, or absent
  VARIANT 3: note = MISC_FEATURE - Xaa at position 3 is A, D, E, F, G, H, I, K, L, N, P, Q, R, S, T, V, Y, W, or absent
  VARIANT 4: note = MISC_FEATURE - Xaa at position 4 is A, D, E, F, G, H, I, K, L, N, P, Q, R, S, T, V, Y, W, or absent
  VARIANT 6: note = MISC_FEATURE - Xaa at position 6 is A, D, E, F, G, H, I, K, L, N, P, Q, R, S, T, V, Y, W, or absent
  VARIANT 7: note = MISC_FEATURE - Xaa at position 7 is A, D, E, F, G, H, I, K, L, N, P, Q, R, S, T, V, Y, W, or absent
  VARIANT 8: note = MISC_FEATURE - Xaa at position 8 is A, D, E, F, G, H, I, K, L, N, P, Q, R, S, T, V, Y, W, or absent
  VARIANT 9: note = MISC_FEATURE - Xaa at position 9 is A, D, E, F, G, H, I, K, L, N, P, Q, R, S, T, V, Y, W, or absent
  VARIANT 10: note = MISC_FEATURE - Xaa at position 10 is A, D, E, F, G, H, I, K, L, N, P, Q, R, S, T, V, Y, W, or absent
  VARIANT 11: note = MISC_FEATURE - Xaa at position 11 is A, D, E, F, G, H, I, K, L, N, P, Q, R, S, T, V, Y, W, or absent
  VARIANT 13: note = MISC_FEATURE - Xaa at position 13 is A, D, E, F, G, H, I, K, L, N, P, Q, R, S, T, V, Y, W, or absent
  VARIANT 14: note = MISC_FEATURE - Xaa at position 14 is A, D, E, F, G, H, I, K, L, N, P, Q, R, S, T, V, Y, W, or absent
  VARIANT 15: note = MISC_FEATURE - Xaa at position 15 is A, D, E, F, G, H, I, K, L, N, P, Q, R, S, T, V, Y, W, or absent
  VARIANT 16: note = MISC_FEATURE - Xaa at position 16 is A, D, E, F, G, H, I, K, L, N, P, Q, R, S, T, V, Y, W, or absent
  VARIANT 33: note = MISC_FEATURE - Xaa at position 33 is A, D, E, F, G, H, I, K, L, N, P, Q, R, S, T, V, Y, W, or absent
  VARIANT 34: note = MISC_FEATURE - Xaa at position 34 is A, D, E, F, G, H, I, K, L, N, P, Q, R, S, T, V, Y, W, or absent
  VARIANT 35: note = MISC_FEATURE - Xaa at position 35 is A, D, E, F, G, H, I, K, L, N, P, Q, R, S, T, V, Y, W, or absent
  VARIANT 41: note = MISC_FEATURE - Xaa at position 41 is A, D, E, F, G, H, I, K, L, N, P, Q, R, S, T, V, Y, W, or absent
  VARIANT 42: note = MISC_FEATURE - Xaa at position 42 is A, D, E, F, G, H, I, K, L, N, P, Q, R, S, T, V, Y, W, or absent
  VARIANT 43: note = MISC_FEATURE - Xaa at position 43 is A, D, E, F, G, H, I, K, L, N, P, Q, R, S, T, V, Y, W, or absent
  VARIANT 44: note = MISC_FEATURE - Xaa at position 44 is A, D, E, F, G, H, I, K, L, N, P, Q, R, S, T, V, Y, W, or absent
  VARIANT 45: note = MISC_FEATURE - Xaa at position 45 is A, D, E, F, G, H, I, K, L, N, P, Q, R, S, T, V, Y, W, or absent
  VARIANT 46: note = MISC_FEATURE - Xaa at position 46 is A, D, E, F, G, H, I, K, L, N, P, Q, R, S, T, V, Y, W, or absent
XXXXKXXXXXXKXXXXQHLCGSHLVEALYLVCXXXGFFYTXXXXXX

SEQ ID NO: 24017 - protein, 46 aa, synthetic construct
  REGION 1..46: note = Synthetic Construct
  VARIANT 1: note = MISC_FEATURE - Xaa at position 1 is A, D, E, F, G, H, I, K, L, N, P, Q, R, S, T, V, Y, W, or absent
  VARIANT 2: note = MISC_FEATURE - Xaa at position 2 is A, D, E, F, G, H, I, K, L, N, P, Q, R, S, T, V, Y, W, or absent
  VARIANT 3: note = MISC_FEATURE - Xaa at position 3 is A, D, E, F, G, H, I, K, L, N, P, Q, R, S, T, V, Y, W, or absent
  VARIANT 4: note = MISC_FEATURE - Xaa at position 4 is A, D, E, F, G, H, I, K, L, N, P, Q, R, S, T, V, Y, W, or absent
  VARIANT 7: note = MISC_FEATURE - Xaa at position 7 is A, E, F, H, I, K, L, N, P, Q, R, S, T, V, Y, W, or absent
  VARIANT 8: note = MISC_FEATURE - Xaa at position 8 is A, D, E, F, G, H, I, K, L, N, P, Q, R, S, T, V, Y, W, or absent
  VARIANT 9: note = MISC_FEATURE - Xaa at position 9 is A, D, E, F, G, H, I, K, L, N, P, Q, R, S, T, V, Y, W, or absent
  VARIANT 10: note = MISC_FEATURE - Xaa at position 10 is A, D, E, F, G, H, I, K, L, N, P, Q, R, S, T, V, Y, W, or absent
  VARIANT 11: note = MISC_FEATURE - Xaa at position 11 is A, D, E, F, G, H, I, K, L, N, P, Q, R, S, T, V, Y, W, or absent
  VARIANT 12: note = MISC_FEATURE - Xaa at position 12 is A, D, E, F, G, H, I, K, L, N, P, Q, R, S, T, V, Y, W, or absent
  VARIANT 13: note = MISC_FEATURE - Xaa at position 13 is A, D, E, F, G, H, I, K, L, N, P, Q, R, S, T, V, Y, W, or absent
  VARIANT 14: note = MISC_FEATURE - Xaa at position 14 is A, D, E, F, G, H, I, K, L, N, P, Q, R, S, T, V, Y, W, or absent
  VARIANT 15: note = MISC_FEATURE - Xaa at position 15 is A, D, E, F, G, H, I, K, L, N, P, Q, R, S, T, V, Y, W, or absent
  VARIANT 16: note = MISC_FEATURE - Xaa at position 16 is A, D, E, F, G, H, I, K, L, N, P, Q, R, S, T, V, Y, W, or absent
  VARIANT 33: note = MISC_FEATURE - Xaa at position 33 is A, D, E, F, G, H, I, K, L, N, P, Q, R, S, T, V, Y, W, or absent
  VARIANT 34: note = MISC_FEATURE - Xaa at position 34 is A, D, E, F, G, H, I, K, L, N, P, Q, R, S, T, V, Y, W, or absent
  VARIANT 35: note = MISC_FEATURE - Xaa at position 35 is A, D, E, F, G, H, I, K, L, N, P, Q, R, S, T, V, Y, W, or absent
  VARIANT 41: note = MISC_FEATURE - Xaa at position 41 is A, D, E, F, G, H, I, K, L, N, P, Q, R, S, T, V, Y, W, or absent
  VARIANT 42: note = MISC_FEATURE - Xaa at position 42 is A, D, E, F, G, H, I, K, L, N, P, Q, R, S, T, V, Y, W, or absent
  VARIANT 43: note = MISC_FEATURE - Xaa at position 43 is A, D, E, F, G, H, I, K, L, N, P, Q, R, S, T, V, Y, W, or absent
  VARIANT 44: note = MISC_FEATURE - Xaa at position 44 is A, D, E, F, G, H, I, K, L, N, P, Q, R, S, T, V, Y, W, or absent
  VARIANT 45: note = MISC_FEATURE - Xaa at position 45 is A, D, E, F, G, H, I, K, L, N, P, Q, R, S, T, V, Y, W, or absent
  VARIANT 46: note = MISC_FEATURE - Xaa at position 46 is A, D, E, F, G, H, I, K, L, N, P, Q, R, S, T, V, Y, W, or absent
XXXXKPXXXXXXXXXXQHLCGSHLVEALYLVCXXXGFFYTXXXXXX

SEQ ID NO: 24018 - protein, 46 aa, synthetic construct; identical to SEQ ID NO: 24016
  REGION 1..46: note = Synthetic Construct
  VARIANT 1: note = MISC_FEATURE - Xaa at position 1 is A, D, E, F, G, H, I, K, L, N, P, Q, R, S, T, V, Y, W, or absent
  VARIANT 2: note = MISC_FEATURE - Xaa at position 2 is A, D, E, F, G, H, I, K, L, N, P, Q, R, S, T, V, Y, W, or absent
  VARIANT 3: note = MISC_FEATURE - Xaa at position 3 is A, D, E, F, G, H, I, K, L, N, P, Q, R, S, T, V, Y, W, or absent
  VARIANT 4: note = MISC_FEATURE - Xaa at position 4 is A, D, E, F, G, H, I, K, L, N, P, Q, R, S, T, V, Y, W, or absent
  VARIANT 6: note = MISC_FEATURE - Xaa at position 6 is A, D, E, F, G, H, I, K, L, N, P, Q, R, S, T, V, Y, W, or absent
  REGION 6..11: note = MISC_FEATURE - wherein at least one of Xaa at positions 6, 7, 8, 9, 10, 11 is present and at least one of Xaa at positions 6, 7, 8, 9, 10, 11 is G
  VARIANT 7: note = MISC_FEATURE - Xaa at position 7 is A, D, E, F, G, H, I, K, L, N, P, Q, R, S, T, V, Y, W, or absent
  VARIANT 8: note = MISC_FEATURE - Xaa at position 8 is A, D, E, F, G, H, I, K, L, N, P, Q, R, S, T, V, Y, W, or absent
  VARIANT 9: note = MISC_FEATURE - Xaa at position 9 is A, D, E, F, G, H, I, K, L, N, P, Q, R, S, T, V, Y, W, or absent
  VARIANT 10: note = MISC_FEATURE - Xaa at position 10 is A, D, E, F, G, H, I, K, L, N, P, Q, R, S, T, V, Y, W, or absent
  VARIANT 11: note = MISC_FEATURE - Xaa at position 11 is A, D, E, F, G, H, I, K, L, N, P, Q, R, S, T, V, Y, W, or absent
  VARIANT 13: note = MISC_FEATURE - Xaa at position 13 is A, D, E, F, G, H, I, K, L, N, P, Q, R, S, T, V, Y, W, or absent
  VARIANT 14: note = MISC_FEATURE - Xaa at position 14 is A, D, E, F, G, H, I, K, L, N, P, Q, R, S, T, V, Y, W, or absent
  VARIANT 15: note = MISC_FEATURE - Xaa at position 15 is A, D, E, F, G, H, I, K, L, N, P, Q, R, S, T, V, Y, W, or absent
  VARIANT 16: note = MISC_FEATURE - Xaa at position 16 is A, D, E, F, G, H, I, K, L, N, P, Q, R, S, T, V, Y, W, or absent
  VARIANT 33: note = MISC_FEATURE - Xaa at position 33 is A, D, E, F, G, H, I, K, L, N, P, Q, R, S, T, V, Y, W, or absent
  VARIANT 34: note = MISC_FEATURE - Xaa at position 34 is A, D, E, F, G, H, I, K, L, N, P, Q, R, S, T, V, Y, W, or absent
  VARIANT 35: note = MISC_FEATURE - Xaa at position 35 is A, D, E, F, G, H, I, K, L, N, P, Q, R, S, T, V, Y, W, or absent
  VARIANT 41: note = MISC_FEATURE - Xaa at position 41 is A, D, E, F, G, H, I, K, L, N, P, Q, R, S, T, V, Y, W, or absent
  VARIANT 42: note = MISC_FEATURE - Xaa at position 42 is A, D, E, F, G, H, I, K, L, N, P, Q, R, S, T, V, Y, W, or absent
  VARIANT 43: note = MISC_FEATURE - Xaa at position 43 is A, D, E, F, G, H, I, K, L, N, P, Q, R, S, T, V, Y, W, or absent
  VARIANT 44: note = MISC_FEATURE - Xaa at position 44 is A, D, E, F, G, H, I, K, L, N, P, Q, R, S, T, V, Y, W, or absent
  VARIANT 45: note = MISC_FEATURE - Xaa at position 45 is A, D, E, F, G, H, I, K, L, N, P, Q, R, S, T, V, Y, W, or absent
  VARIANT 46: note = MISC_FEATURE - Xaa at position 46 is A, D, E, F, G, H, I, K, L, N, P, Q, R, S, T, V, Y, W, or absent

SEQ ID NO: 24019 - protein, 46 aa, synthetic construct; identical to SEQ ID NO: 24016
  REGION 1..46: note = Synthetic Construct
  VARIANT 1: note = MISC_FEATURE - Xaa at position 1 is A, D, E, F, G, H, I, K, L, N, P, Q, R, S, T, V, Y, W, or absent
  VARIANT 2: note = MISC_FEATURE - Xaa at position 2 is A, D, E, F, G, H, I, K, L, N, P, Q, R, S, T, V, Y, W, or absent
  VARIANT 3: note = MISC_FEATURE - Xaa at position 3 is A, D, E, F, G, H, I, K, L, N, P, Q, R, S, T, V, Y, W, or absent
  VARIANT 4: note = MISC_FEATURE - Xaa at position 4 is A, D, E, F, G, H, I, K, L, N, P, Q, R, S, T, V, Y, W, or absent
  VARIANT 6: note = MISC_FEATURE - Xaa at position 6 is A, D, E, F, G, H, I, K, L, N, P, Q, R, S, T, V, Y, W, or absent
  REGION 6..11: note = MISC_FEATURE - wherein at least one of Xaa at positions 6, 7, 8, 9, 10, 11 is present and at least one of Xaa at positions 6, 7, 8, 9, 10, 11 is S
  VARIANT 7: note = MISC_FEATURE - Xaa at position 7 is A, D, E, F, G, H, I, K, L, N, P, Q, R, S, T, V, Y, W, or absent
  VARIANT 8: note = MISC_FEATURE - Xaa at position 8 is A, D, E, F, G, H, I, K, L, N, P, Q, R, S, T, V, Y, W, or absent
  VARIANT 9: note = MISC_FEATURE - Xaa at position 9 is A, D, E, F, G, H, I, K, L, N, P, Q, R, S, T, V, Y, W, or absent
  VARIANT 10: note = MISC_FEATURE - Xaa at position 10 is A, D, E, F, G, H, I, K, L, N, P, Q, R, S, T, V, Y, W, or absent
  VARIANT 11: note = MISC_FEATURE - Xaa at position 11 is A, D, E, F, G, H, I, K, L, N, P, Q, R, S, T, V, Y, W, or absent
  VARIANT 13: note = MISC_FEATURE - Xaa at position 13 is A, D, E, F, G, H, I, K, L, N, P, Q, R, S, T, V, Y, W, or absent
  VARIANT 14: note = MISC_FEATURE - Xaa at position 14 is A, D, E, F, G, H, I, K, L, N, P, Q, R, S, T, V, Y, W, or absent
  VARIANT 15: note = MISC_FEATURE - Xaa at position 15 is A, D, E, F, G, H, I, K, L, N, P, Q, R, S, T, V, Y, W, or absent
  VARIANT 16: note = MISC_FEATURE - Xaa at position 16 is A, D, E, F, G, H, I, K, L, N, P, Q, R, S, T, V, Y, W, or absent
  VARIANT 33: note = MISC_FEATURE - Xaa at position 33 is A, D, E, F, G, H, I, K, L, N, P, Q, R, S, T, V, Y, W, or absent
  VARIANT 34: note = MISC_FEATURE - Xaa at position 34 is A, D, E, F, G, H, I, K, L, N, P, Q, R, S, T, V, Y, W, or absent
  VARIANT 35: note = MISC_FEATURE - Xaa at position 35 is A, D, E, F, G, H, I, K, L, N, P, Q, R, S, T, V, Y, W, or absent
  VARIANT 41: note = MISC_FEATURE - Xaa at position 41 is A, D, E, F, G, H, I, K, L, N, P, Q, R, S, T, V, Y, W, or absent
  VARIANT 42: note = MISC_FEATURE - Xaa at position 42 is A, D, E, F, G, H, I, K, L, N, P, Q, R, S, T, V, Y, W, or absent
  VARIANT 43: note = MISC_FEATURE - Xaa at position 43 is A, D, E, F, G, H, I, K, L, N, P, Q, R, S, T, V, Y, W, or absent
  VARIANT 44: note = MISC_FEATURE - Xaa at position 44 is A, D, E, F, G, H, I, K, L, N, P, Q, R, S, T, V, Y, W, or absent
  VARIANT 45: note = MISC_FEATURE - Xaa at position 45 is A, D, E, F, G, H, I, K, L, N, P, Q, R, S, T, V, Y, W, or absent
  VARIANT 46: note = MISC_FEATURE - Xaa at position 46 is A, D, E, F, G, H, I, K, L, N, P, Q, R, S, T, V, Y, W, or absent

SEQ ID NO: 24020 - protein, 46 aa, synthetic construct; identical to SEQ ID NO: 24016
  REGION 1..46: note = Synthetic Construct
  VARIANT 1: note = MISC_FEATURE - Xaa at position 1 is A, D, E, F, G, H, I, K, L, N, P, Q, R, S, T, V, Y, W, or absent
  VARIANT 2: note = MISC_FEATURE - Xaa at position 2 is A, D, E, F, G, H, I, K, L, N, P, Q, R, S, T, V, Y, W, or absent
  VARIANT 3: note = MISC_FEATURE - Xaa at position 3 is A, D, E, F, G, H, I, K, L, N, P, Q, R, S, T, V, Y, W, or absent
  VARIANT 4: note = MISC_FEATURE - Xaa at position 4 is A, D, E, F, G, H, I, K, L, N, P, Q, R, S, T, V, Y, W, or absent
  VARIANT 6: note = MISC_FEATURE - Xaa at position 6 is A, D, E, F, G, H, I, K, L, N, P, Q, R, S, T, V, Y, W, or absent
  REGION 6..11: note = MISC_FEATURE - wherein at least two of Xaa at positions 6, 7, 8, 9, 10, 11 are present and at least one of Xaa at positions 6, 7, 8, 9, 10, 11 is S and another is G
  VARIANT 7: note = MISC_FEATURE - Xaa at position 7 is A, D, E, F, G, H, I, K, L, N, P, Q, R, S, T, V, Y, W, or absent
  VARIANT 8: note = MISC_FEATURE - Xaa at position 8 is A, D, E, F, G, H, I, K, L, N, P, Q, R, S, T, V, Y, W, or absent
  VARIANT 9: note = MISC_FEATURE - Xaa at position 9 is A, D, E, F, G, H, I, K, L, N, P, Q, R, S, T, V, Y, W, or absent
  VARIANT 10: note = MISC_FEATURE - Xaa at position 10 is A, D, E, F, G, H, I, K, L, N, P, Q, R, S, T, V, Y, W, or absent
  VARIANT 11: note = MISC_FEATURE - Xaa at position 11 is A, D, E, F, G, H, I, K, L, N, P, Q, R, S, T, V, Y, W, or absent
  VARIANT 13: note = MISC_FEATURE - Xaa at position 13 is A, D, E, F, G, H, I, K, L, N, P, Q, R, S, T, V, Y, W, or absent
  VARIANT 14: note = MISC_FEATURE - Xaa at position 14 is A, D, E, F, G, H, I, K, L, N, P, Q, R, S, T, V, Y, W, or absent
  VARIANT 15: note = MISC_FEATURE - Xaa at position 15 is A, D, E, F, G, H, I, K, L, N, P, Q, R, S, T, V, Y, W, or absent
  VARIANT 16: note = MISC_FEATURE - Xaa at position 16 is A, D, E, F, G, H, I, K, L, N, P, Q, R, S, T, V, Y, W, or absent
  VARIANT 33: note = MISC_FEATURE - Xaa at position 33 is A, D, E, F, G, H, I, K, L, N, P, Q, R, S, T, V, Y, W, or absent
  VARIANT 34: note = MISC_FEATURE - Xaa at position 34 is A, D, E, F, G, H, I, K, L, N, P, Q, R, S, T, V, Y, W, or absent
  VARIANT 35: note = MISC_FEATURE - Xaa at position 35 is A, D, E, F, G, H, I, K, L, N, P, Q, R, S, T, V, Y, W, or absent
  VARIANT 41: note = MISC_FEATURE - Xaa at position 41 is A, D, E, F, G, H, I, K, L, N, P, Q, R, S, T, V, Y, W, or absent
  VARIANT 42: note = MISC_FEATURE - Xaa at position 42 is A, D, E, F, G, H, I, K, L, N, P, Q, R, S, T, V, Y, W, or absent
  VARIANT 43: note = MISC_FEATURE - Xaa at position 43 is A, D, E, F, G, H, I, K, L, N, P, Q, R, S, T, V, Y, W, or absent
  VARIANT 44: note = MISC_FEATURE - Xaa at position 44 is A, D, E, F, G, H, I, K, L, N, P, Q, R, S, T, V, Y, W, or absent
  VARIANT 45: note = MISC_FEATURE - Xaa at position 45 is A, D, E, F, G, H, I, K, L, N, P, Q, R, S, T, V, Y, W, or absent
  VARIANT 46: note = MISC_FEATURE - Xaa at position 46 is A, D, E, F, G, H, I, K, L, N, P, Q, R, S, T, V, Y, W, or absent

SEQ ID NO: 24021 - protein, 24 aa, synthetic construct
  VARIANT 3: note = L or D-amino acid
  VARIANT 4: note = L or D-amino acid
  VARIANT 9: note = L or D-amino acid
  VARIANT 10: note = L or D-amino acid
  VARIANT 15: note = L or D-amino acid
  VARIANT 16: note = L or D-amino acid
  VARIANT 21: note = L or D-amino acid
  VARIANT 22: note = L or D-amino acid
  VARIANT 1..2: note = This region may encompass one of the following sequences: K or KP
  VARIANT 5..6: note = This region may encompass one of the following sequences: K or KP
  VARIANT 7..8: note = This region may encompass one of the following sequences: K or KP
  VARIANT 11..12: note = This region may encompass one of the following sequences: K or KP
  VARIANT 13..14: note = This region may encompass one of the following sequences: K or KP
  VARIANT 17..18: note = This region may encompass one of the following sequences: K or KP
  VARIANT 19..20: note = This region may encompass one of the following sequences: K or KP
  VARIANT 23..24: note = This region may encompass one of the following sequences: K or KP
  VARIANT 1..24: note = This sequence may encompass 1-4 XXAAXX repeating units, wherein XX represents K or KP
XXAAXXXXAAXXXXAAXXXXAAXX

SEQ ID NO: 24022 - protein, 28 aa, synthetic construct
  VARIANT 3: note = L or D-amino acid
  VARIANT 4: note = L or D-amino acid
  VARIANT 5: note = L or D-amino acid
  VARIANT 10: note = L or D-amino acid
  VARIANT 11: note = L or D-amino acid
  VARIANT 12: note = L or D-amino acid
  VARIANT 17: note = L or D-amino acid
  VARIANT 18: note = L or D-amino acid
  VARIANT 19: note = L or D-amino acid
  VARIANT 24: note = L or D-amino acid
  VARIANT 25: note = L or D-amino acid
  VARIANT 26: note = L or D-amino acid
  VARIANT 1..2: note = This region may encompass one of the following sequences: K or KP
  VARIANT 6..7: note = This region may encompass one of the following sequences: K or KP
  VARIANT 8..9: note = This region may encompass one of the following sequences: K or KP
  VARIANT 13..14: note = This region may encompass one of the following sequences: K or KP
  VARIANT 15..16: note = This region may encompass one of the following sequences: K or KP
  VARIANT 20..21: note = This region may encompass one of the following sequences: K or KP
  VARIANT 22..23: note = This region may encompass one of the following sequences: K or KP
  VARIANT 27..28: note = This region may encompass one of the following sequences: K or KP
  VARIANT 1..28: note = This sequence may encompass 1-4 XXAAAXX repeating units, wherein XX represents K or KP
XXAAAXXXXAAAXXXXAAAXXXXAAAXX

SEQ ID NO: 24023 - protein, 40 aa, synthetic construct
  VARIANT 3: note = L or D-amino acid
  VARIANT 8: note = L or D-amino acid
  VARIANT 13: note = L or D-amino acid
  VARIANT 18: note = L or D-amino acid
  VARIANT 1..2: note = This region may encompass one of the following sequences: K or KP
  VARIANT 4..5: note = This region may encompass one of the following sequences: K or KP
  VARIANT 6..7: note = This region may encompass one of the following sequences: K or KP
  VARIANT 9..10: note = This region may encompass one of the following sequences: K or KP
  VARIANT 11..12: note = This region may encompass one of the following sequences: K or KP
  VARIANT 14..15: note = This region may encompass one of the following sequences: K or KP
  VARIANT 16..17: note = This region may encompass one of the following sequences: K or KP
  VARIANT 19..20: note = This region may encompass one of the following sequences: K or KP
  VARIANT 1..20: note = This region may encompass 1-4 XXAXX repeating units, wherein XX represents K or KP
  VARIANT 21..40: note = This region may encompass 1-4 GGGGS repeating units
XXAXXXXAXXXXAXXXXAXXGGGGSGGGGSGGGGSGGGGS

SEQ ID NO: 24024 - protein, 44 aa, synthetic construct
  VARIANT 3: note = L or D-amino acid
  VARIANT 4: note = L or D-amino acid
  VARIANT 9: note = L or D-amino acid
  VARIANT 10: note = L or D-amino acid
  VARIANT 15: note = L or D-amino acid
  VARIANT 16: note = L or D-amino acid
  VARIANT 21: note = L or D-amino acid
  VARIANT 22: note = L or D-amino acid
  VARIANT 1..2: note = This region may encompass one of the following sequences: K or KP
  VARIANT 5..6: note = This region may encompass one of the following sequences: K or KP
  VARIANT 7..8: note = This region may encompass one of the following sequences: K or KP
  VARIANT 11..12: note = This region may encompass one of the following sequences: K or KP
  VARIANT 13..14: note = This region may encompass one of the following sequences: K or KP
  VARIANT 17..18: note = This region may encompass one of the following sequences: K or KP
  VARIANT 19..20: note = This region may encompass one of the following sequences: K or KP
  VARIANT 23..24: note = This region may encompass one of the following sequences: K or KP
  VARIANT 1..24: note = This region may encompass 1-4 XXAAXX repeating units, wherein XX represents K or KP
  VARIANT 25..44: note = This region may encompass 1-4 GGGGS repeating units
XXAAXXXXAAXXXXAAXXXXAAXXGGGGSGGGGSGGGGSGGGGS

SEQ ID NO: 24025 - protein, 48 aa, synthetic construct
  VARIANT 3: note = L or D-amino acid
  VARIANT 4: note = L or D-amino acid
  VARIANT 5: note = L or D-amino acid
  VARIANT 10: note = L or D-amino acid
  VARIANT 11: note = L or D-amino acid
  VARIANT 12: note = L or D-amino acid
  VARIANT 17: note = L or D-amino acid
  VARIANT 18: note = L or D-amino acid
  VARIANT 19: note = L or D-amino acid
  VARIANT 24: note = L or D-amino acid
  VARIANT 25: note = L or D-amino acid
  VARIANT 26: note = L or D-amino acid
  VARIANT 1..2: note = This region may encompass one of the following sequences: K or KP
  VARIANT 6..7: note = This region may encompass one of the following sequences: K or KP
  VARIANT 8..9: note = This region may encompass one of the following sequences: K or KP
  VARIANT 13..14: note = This region may encompass one of the following sequences: K or KP
  VARIANT 15..16: note = This region may encompass one of the following sequences: K or KP
  VARIANT 20..21: note = This region may encompass one of the following sequences: K or KP
  VARIANT 22..23: note = This region may encompass one of the following sequences: K or KP
  VARIANT 27..28: note = This region may encompass one of the following sequences: K or KP
  VARIANT 1..28: note = This region may encompass 1-4 XXAAAXX repeating units, wherein XX represents K or KP
  VARIANT 29..48: note = This region may encompass 1-4 GGGGS repeating units
XXAAAXXXXAAAXXXXAAAXXXXAAAXXGGGGSGGGGSGGGGSGGGGS

SEQ ID NO: 24026 - protein, 60 aa, synthetic construct
  VARIANT 3: note = L or D-amino acid
  VARIANT 8: note = L or D-amino acid
  VARIANT 13: note = L or D-amino acid
  VARIANT 18: note = L or D-amino acid
  VARIANT 43: note = L or D-amino acid
  VARIANT 48: note = L or D-amino acid
  VARIANT 53: note = L or D-amino acid
  VARIANT 58: note = L or D-amino acid
  VARIANT 1..2: note = This region may encompass one of the following sequences: K or KP
  VARIANT 4..5: note = This region may encompass one of the following sequences: K or KP
  VARIANT 6..7: note = This region may encompass one of the following sequences: K or KP
  VARIANT 9..10: note = This region may encompass one of the following sequences: K or KP
  VARIANT 11..12: note = This region may encompass one of the following sequences: K or KP
  VARIANT 14..15: note = This region may encompass one of the following sequences: K or KP
  VARIANT 16..17: note = This region may encompass one of the following sequences: K or KP
  VARIANT 19..20: note = This region may encompass one of the following sequences: K or KP
  VARIANT 1..20: note = This region may encompass 1-4 XXAXX repeating units, wherein XX represents K or KP
  VARIANT 21..40: note = This region may encompass 1-4 GGGGS repeating units
  VARIANT 41..42: note = This region may encompass one of the following sequences: K or KP
  VARIANT 44..45: note = This region may encompass one of the following sequences: K or KP
  VARIANT 46..47: note = This region may encompass one of the following sequences: K or KP
  VARIANT 49..50: note = This region may encompass one of the following sequences: K or KP
  VARIANT 51..52: note = This region may encompass one of the following sequences: K or KP
  VARIANT 54..55: note = This region may encompass one of the following sequences: K or KP
  VARIANT 56..57: note = This region may encompass one of the following sequences: K or KP
  VARIANT 59..60: note = This region may encompass one of the following sequences: K or KP
  VARIANT 41..60: note = This region may encompass 1-4 XXAXX repeating units, wherein XX represents K or KP
XXAXXXXAXXXXAXXXXAXXGGGGSGGGGSGGGGSGGGGSXXAXXXXAXXXXAXXXXAXX

SEQ ID NO: 24027 - protein, 68 aa, synthetic construct
  VARIANT 3: note = L or D-amino acid
  VARIANT 4: note = L or D-amino acid
  VARIANT 9: note = L or D-amino acid
  VARIANT 10: note = L or D-amino acid
  VARIANT 15: note = L or D-amino acid
  VARIANT 16: note = L or D-amino acid
  VARIANT 21: note = L or D-amino acid
  VARIANT 22: note = L or D-amino acid
  VARIANT 47: note = L or D-amino acid
  VARIANT 48: note = L or D-amino acid
  VARIANT 53: note = L or D-amino acid
  VARIANT 54: note = L or D-amino acid
  VARIANT 59: note = L or D-amino acid
  VARIANT 60: note = L or D-amino acid
  VARIANT 65: note = L or D-amino acid
  VARIANT 66: note = L or D-amino acid
  VARIANT 1..2: note = This region may encompass one of the following sequences: K or KP
  VARIANT 5..6: note = This region may encompass one of the following sequences: K or KP
  VARIANT 7..8: note = This region may encompass one of the following sequences: K or KP
  VARIANT 11..12: note = This region may encompass one of the following sequences: K or KP
  VARIANT 13..14: note = This region may encompass one of the following sequences: K or KP
  VARIANT 17..18: note = This region may encompass one of the following sequences: K or KP
  VARIANT 19..20: note = This region may encompass one of the following sequences: K or KP
  VARIANT 23..24: note = This region may encompass one of the following sequences: K or KP
  VARIANT 1..24: note = This region may encompass 1-4 XXAAXX repeating units, wherein XX represents K or KP
  VARIANT 25..44: note = This region may encompass 1-4 GGGGS repeating units
  VARIANT 45..46: note = This region may encompass one of the following sequences: K or KP
  VARIANT 49..50: note = This region may encompass one of the following sequences: K or KP
  VARIANT 51..52: note = This region may encompass one of the following sequences: K or KP
  VARIANT 55..56: note = This region may encompass one of the following sequences: K or KP
  VARIANT 57..58: note = This region may encompass one of the following sequences: K or KP
  VARIANT 61..62: note = This region may encompass one of the following sequences: K or KP
  VARIANT 63..64: note = This region may encompass one of the following sequences: K or KP
  VARIANT 67..68: note = This region may encompass one of the following sequences: K or KP
  VARIANT 45..68: note = This region may encompass 1-4 XXAAXX repeating units, wherein XX represents K or KP
XXAAXXXXAAXXXXAAXXXXAAXXGGGGSGGGGSGGGGSGGGGSXXAAXXXXAAXXXXAAXXXXAAXX

SEQ ID NO: 24028 - protein, 144 aa, synthetic construct
  VARIANT 4: note = L or D-amino acid
  VARIANT 8: note = L or D-amino acid
  VARIANT 15: note = L or D-amino acid
  VARIANT 19: note = L or D-amino acid
  VARIANT 26: note = L or D-amino acid
  VARIANT 30: note = L or D-amino acid
  VARIANT 37: note = L or D-amino acid
  VARIANT 41: note = L or D-amino acid
  VARIANT 79: note = L or D-amino acid
  VARIANT 97: note = L or D-amino acid
  VARIANT 115: note = L or D-amino acid
  VARIANT 133: note = L or D-amino acid
  VARIANT 2..3: note = This region may encompass one of the following sequences: KV or KP
  VARIANT 9..10: note = This region may encompass one of the following sequences: KV or KP
  VARIANT 13..14: note = This region may encompass one of the following sequences: KV or KP
  VARIANT 20..21: note = This region may encompass one of the following sequences: KV or KP
  VARIANT 24..25: note = This region may encompass one of the following sequences: KV or KP
  VARIANT 31..32: note = This region may encompass one of the following sequences: KV or KP
  VARIANT 35..36: note = This region may encompass one of the following sequences: KV or KP
  VARIANT 42..43: note = This region may encompass one of the following sequences: KV or KP
  VARIANT 1..44: note = This region may encompass 1-4 GXXAKGEAXXT repeating units, wherein XX represents KV or KP
  VARIANT 45..72: note = This region may encompass 1-4 GGSGSSS repeating units
  VARIANT 74..75: note = This region may encompass one of the following sequences: KV or KP
  VARIANT 77..78: note = This region may encompass one of the following sequences: KV or KP
  VARIANT 88..89: note = This region may encompass one of the following sequences: KV or KP
  VARIANT 92..93: note = This region may encompass one of the following sequences: KV or KP
  VARIANT 95..96: note = This region may encompass one of the following sequences: KV or KP
  VARIANT 106..107: note = This region may encompass one of the following sequences: KV or KP
  VARIANT 110..111: note = This region may encompass one of the following sequences: KV or KP
  VARIANT 113..114: note = This region may encompass one of the following sequences: KV or KP
  VARIANT 124..125: note = This region may encompass one of the following sequences: KV or KP
  VARIANT 128..129: note = This region may encompass one of the following sequences: KV or KP
  VARIANT 131..132: note = This region may encompass one of the following sequences: KV or KP
  VARIANT 142..143: note = This region may encompass one of the following sequences: KV or KP
  VARIANT 73..144: note = This region may encompass 1-4 GXXGXXAGSSSGSSSXXT repeating units, wherein XX represents KV or KP
GXXAKGEAXXTGXXAKGEAXXTGXXAKGEAXXTGXXAKGEAXXTGGSGSSSGGSGSSSGGSGSSSGGSGSSSGXXGXXAGSSSGSSSXXTGXXGXXAGSSSGSSSXXTGXXGXXAGSSSGSSSXXTGXXGXXAGSSSGSSSXXT

SEQ ID NO: 24029 - protein, 40 aa, synthetic construct
  VARIANT 4: note = L or D-amino acid
  VARIANT 7: note = L or D-amino acid
  VARIANT 14: note = L or D-amino acid
  VARIANT 17: note = L or D-amino acid
  VARIANT 24: note = L or D-amino acid
  VARIANT 27: note = L or D-amino acid
  VARIANT 34: note = L or D-amino acid
  VARIANT 37: note = L or D-amino acid
  VARIANT 2..3: note = This region may encompass one of the following sequences: KV or KP
  VARIANT 12..13: note = This region may encompass one of the following sequences: KV or KP
  VARIANT 22..23: note = This region may encompass one of the following sequences: KV or KP
  VARIANT 32..33: note = This region may encompass one of the following sequences: KV or KP
  VARIANT 1..40: note = This sequence may encompass 1-4 GXXAESALYL repeating units, wherein XX represents KV or KP
GXXAESALYLGXXAESALYLGXXAESALYLGXXAESALYL

SEQ ID NO: 24030 - protein, 40 aa, synthetic construct
  VARIANT 2..3: note = This region may encompass one of the following sequences: KV or KP
  VARIANT 5..6: note = This region may encompass one of the following sequences: KV or KP
  VARIANT 8..9: note = This region may encompass one of the following sequences: KV or KP
  VARIANT 11..12: note = This region may encompass one of the following sequences: KV or KP
  VARIANT 14..15: note = This region may encompass one of the following sequences: KV or KP
  VARIANT 17..18: note = This region may encompass one of the following sequences: KV or KP
  VARIANT 20..21: note = This region may encompass one of the following sequences: KV or KP
  VARIANT 23..24: note = This region may encompass one of the following sequences: KV or KP
  VARIANT 1..24: note = This region may encompass 1-4 TXXEXX repeating units, wherein XX represents KV or KP
  VARIANT 25..40: note = This region may encompass 1-4 GPGS repeating units
TXXEXXTXXEXXTXXEXXTXXEXXGPGSGPGSGPGSGPGS

SEQ ID NO: 24031 - protein, 44 aa, synthetic construct
  VARIANT 6: note = L or D-amino acid
  VARIANT 14: note = L or D-amino acid
  VARIANT 22: note = L or D-amino acid
  VARIANT 30: note = L or D-amino acid
  VARIANT 34: note = L or D-amino acid
  VARIANT 37: note = L or D-amino acid
  VARIANT 40: note = L or D-amino acid
  VARIANT 43: note = L or D-amino acid
  VARIANT 2..3: note = This region may encompass one of the following sequences: KV or KP
  VARIANT 10..11: note = This region may encompass one of the following sequences: KV or KP
  VARIANT 18..19: note = This region may encompass one of the following sequences: KV or KP
  VARIANT 26..27: note = This region may encompass one of the following sequences: KV or KP
  VARIANT 1..32: note = This region may encompass 1-4 GXXESAVA repeating units, wherein XX represents KV or KP
  VARIANT 33..44: note = This region may encompass 1-4 KAK repeating units
GXXESAVAGXXESAVAGXXESAVAGXXESAVAKAKKAKKAKKAK

SEQ ID NO: 24032 - protein, 68 aa, synthetic construct
  VARIANT 5: note = L or D-amino acid
  VARIANT 6: note = L or D-amino acid
  VARIANT 11: note = L or D-amino acid
  VARIANT 12: note = L or D-amino acid
  VARIANT 17: note = L or D-amino acid
  VARIANT 18: note = L or D-amino acid
  VARIANT 23: note = L or D-amino acid
  VARIANT 24: note = L or D-amino acid
  VARIANT 39: note = L or D-amino acid
  VARIANT 47: note = L or D-amino acid
  VARIANT 55: note = L or D-amino acid
  VARIANT 63: note = L or D-amino acid
  VARIANT 2..3: note = This region may encompass one of the following sequences: KV or KP
  VARIANT 8..9: note = This region may encompass one of the following sequences: KV or KP
  VARIANT 14..15: note = This region may encompass one of the following sequences: KV or KP
  VARIANT 20..21: note = This region may encompass one of the following sequences: KV or KP
  VARIANT 1..24: note = This region may encompass 1-4 GXXEAA repeating units, wherein XX represents KV or KP
  VARIANT 25..36: note = This region may encompass 1-4 GGS repeating units
  VARIANT 40..41: note = This region may encompass one of the following sequences: KV or KP
  VARIANT 42..43: note = This region may encompass one of the following sequences: KV or KP
  VARIANT 48..49: note = This region may encompass one of the following sequences: KV or KP
  VARIANT 50..51: note = This region may encompass one of the following sequences: KV or KP
  VARIANT 56..57: note = This region may encompass one of the following sequences: KV or KP
  VARIANT 58..59: note = This region may encompass one of the following sequences: KV or KP
  VARIANT 64..65: note = This region may encompass one of the following sequences: KV or KP
  VARIANT 66..67: note = This region may encompass one of the following sequences: KV or KP
  VARIANT 37..68: note = This region may encompass 1-4 TYAXXXXT repeating units, wherein XX represents KV or KP
GXXEAAGXXEAAGXXEAAGXXEAAGGSGGSGGSGGSTYAXXXXTTYAXXXXTTYAXXXXTTYAXXXXT

SEQ ID NO: 24033 - protein, 48 aa, synthetic construct
  VARIANT 2..3: note = This region may encompass one of the following sequences: KV or KP
  VARIANT 5..6: note = This region may encompass one of the following sequences: KV or KP
  VARIANT 10..11: note = This region may encompass one of the following sequences: KV or KP
  VARIANT 13..14: note = This region may encompass one of the following sequences: KV or KP
  VARIANT 18..19: note = This region may encompass one of the following sequences: KV or KP
  VARIANT 21..22: note = This region may encompass one of the following sequences: KV or KP
  VARIANT 26..27: note = This region may encompass one of the following sequences: KV or KP
  VARIANT 29..30: note = This region may encompass one of the following sequences: KV or KP
  VARIANT 1..32: note = This region may encompass 1-4 TXXAXXYT repeating units, wherein XX represents KV or KP
  VARIANT 33..48: note = This region may encompass 1-4 TSSS repeating units
TXXAXXYTTXXAXXYTTXXAXXYTTXXAXXYTTSSSTSSSTSSSTSSS

SEQ ID NO: 24034 - protein, 80 aa, synthetic construct
  VARIANT 5: note = L or D-amino acid
  VARIANT 11: note = L or D-amino acid
  VARIANT 20: note = L or D-amino acid
  VARIANT 26: note = L or D-amino acid
  VARIANT 35: note = L or D-amino acid
  VARIANT 41: note = L or D-amino acid
  VARIANT 50: note = L or D-amino acid
  VARIANT 56: note = L or D-amino acid
  VARIANT 1..60: note = This region may encompass 1-4 TKPYAKEVETAGSGS repeating units
  VARIANT 61..80: note = This region may encompass 1-4 GGGGS repeating units
TKPYAKEVETAGSGSTKPYAKEVETAGSGSTKPYAKEVETAGSGSTKPYAKEVETAGSGSGGGGSGGGGSGGGGSGGGGS

SEQ ID NO: 24035 - protein, 152 aa, synthetic construct
  VARIANT 6: note = L or D-amino acid
  VARIANT 19: note = L or D-amino acid
  VARIANT 26: note = L or D-amino acid
  VARIANT 39: note = L or D-amino acid
  VARIANT 46: note = L or D-amino acid
  VARIANT 59: note = L or D-amino acid
  VARIANT 66: note = L or D-amino acid
  VARIANT 79: note = L or D-amino acid
  VARIANT 88: note = L or D-amino acid
  VARIANT 93: note = L or D-amino acid
  VARIANT 106: note = L or D-amino acid
  VARIANT 111: note = L or D-amino acid
  VARIANT 124: note = L or D-amino acid
  VARIANT 129: note = L or D-amino acid
  VARIANT 142: note = L or D-amino acid
  VARIANT 147: note = L or D-amino acid
  VARIANT 1..80: note = This region may encompass 1-4 YTPLEAKPYSTSYKPYSEAL repeating units
  VARIANT 81..152: note = This region may encompass 1-4 GKPTSLEAFLVEALYTKP repeating units
YTPLEAKPYSTSYKPYSEALYTPLEAKPYSTSYKPYSEALYTPLEAKPYSTSYKPYSEALYTPLEAKPYSTSYKPYSEALGKPTSLEAFLVEALYTKPGKPTSLEAFLVEALYTKPGKPTSLEAFLVEALYTKPGKPTSLEAFLVEALYTKP

SEQ ID NO: 24036 - protein, 248 aa, synthetic construct
  VARIANT 1..68: note = This region may encompass 1-4 GKEALYLTPLESALYKP repeating units
  VARIANT 69..156: note = This region may encompass 1-4 TKPLEALYLKPEILSLKPESLA repeating units
  VARIANT 157..248: note = This region may encompass 1-4 GKPGSSSKPDTSSSGTPKTAAGS repeating units
GKEALYLTPLESALYKPGKEALYLTPLESALYKPGKEALYLTPLESALYKPGKEALYLTPLESALYKPTKPLEALYLKPEILSLKPESLATKPLEALYLKPEILSLKPESLATKPLEALYLKPEILSLKPESLATKPLEALYLKPEILSLKPESLAGKPGSSSKPDTSSSGTPKTAAGSGKPGSSSKPDTSSSGTPKTAAGSGKPGSSSKPDTSSSGTPKTAAGSGKPGSSSKPDTSSSGTPKTAAGS

SEQ ID NO: 24037 - protein, 7 aa, synthetic construct
  REGION 1..7: note = Synthetic Construct
KSNAPQK

SEQ ID NO: 24038 - protein, 7 aa, synthetic construct
  REGION 1..7: note = Synthetic Construct
KNASPQK

SEQ ID NO: 24039 - protein, 6 aa, synthetic construct
  REGION 1..6: note = Synthetic Construct
KLWAVK

SEQ ID NO: 24040 - protein, 6 aa, synthetic construct
  REGION 1..6: note = Synthetic Construct
KGARLK

SEQ ID NO: 24041 - protein, 7 aa, synthetic construct
  REGION 1..7: note = Synthetic Construct
ADKKTLN

SEQ ID NO: 24042 - protein, 8 aa, synthetic construct
  REGION 1..8: note = Synthetic Construct
GSHKGSHK

SEQ ID NO: 24043 - protein, 7 aa, synthetic construct
  REGION 1..7: note = Synthetic Construct
GKPSHKP

SEQ ID NO: 24044 - protein, 6 aa, synthetic construct
  REGION 1..6: note = Synthetic Construct
GKGPSK

SEQ ID NO: 24045 - protein, 6 aa, synthetic construct
  REGION 1..6: note = Synthetic Construct
GKGSKK

SEQ ID NO: 24046 - protein, 7 aa, synthetic construct
  REGION 1..7: note = Synthetic Construct
GKKPGKK

SEQ ID NO: 24047 - protein, 30 aa, synthetic construct
  REGION 1..30: note = Synthetic Construct
FVNQHLCGSHLVEALYLVCGKRGFFYTPKT

SEQ ID NO: 24048 - protein, 29 aa, synthetic construct
  REGION 1..29: note = Synthetic Construct
FVNQHLCGSHLVEALYLVCGKRGFFYTPR

SEQ ID NO: 24049 - protein, 4 aa, synthetic construct
  REGION 1..4: note = Synthetic Construct
KGSH

SEQ ID NO: 24050 - protein, 5 aa, synthetic construct
  REGION 1..5: note = Synthetic Construct
GKGSH

SEQ ID NO: 24051 - protein, 21 aa, synthetic construct
GIVEQCCTSICSLYQLENYCG

SEQ ID NO: 24052 - protein, 21 aa, synthetic construct
GIVEQCCTSICSLEQLENYCG

SEQ ID NO: 24053-24059 - skipped (7 entries)

SEQ ID NO: 24060 - protein, 31 aa, synthetic construct
KFVNQHLCGSHLVEALYLVCGKRGFFYTPKT

SEQ ID NO: 24061 - protein, 33 aa, synthetic construct
KGSHFVNQHLCGSHLVEALYLVCGKRGFFYTPR

SEQ ID NO: 24062 - protein, 30 aa, synthetic construct
KGSHQHLCGSHLVEALYLVCGKRGFFYTPR

SEQ ID NO: 24063 - protein, 31 aa, synthetic construct
KGSHKQHLCGSHLVEALYLVCGKRGFFYTPR

SEQ ID NO: 24064 - protein, 47 aa, synthetic construct
GKPGGGGSGGGGSGGGGSFVNQHLCGSHLVEALYLVCGDRGFFYTPK

SEQ ID NO: 24065 - protein, 21 aa, synthetic construct
  SITE 6: note = s-Acetamidomethyl modified residue
  SITE 7: note = s-Acetamidomethyl modified residue
  SITE 11: note = s-Acetamidomethyl modified residue
GIVKQCCTSICSLYQLENYCN

SEQ ID NO: 24066 - protein, 31 aa, synthetic construct
  SITE 9: note = s-Acetamidomethyl modified residue
  SITE 21: note = 2,2-Dithiopyridine modified residue
GKFVNQHLCGSHLVEALYLVCGERGFFYTPK

SEQ ID NO: 24067 - protein, 108 aa, synthetic construct
  DISULFID 31..94: note = Intrachain disulfide bond
  DISULFID 43..107: note = Intrachain disulfide bond
  DISULFID 93..98: note = Intrachain disulfide bond
MIEGGRGKPGGGGSGGGGSGGGGSFVNQHLCGSHLVEALYLVCGDRGFFYTPKRREAEDLQVGQVELGGGPGAGSLQPLALEGSLQRGIVEQCCTSICSLYQLENYCN

SEQ ID NO: 24068 - protein, 108 aa, synthetic construct; identical to SEQ ID NO: 24067
  DISULFID 31..94: note = Intrachain disulfide bond
  DISULFID 43..107: note = Intrachain disulfide bond
  DISULFID 93..98: note = Intrachain disulfide bond

SEQ ID NO: 24069 - protein, 21 aa, synthetic construct
  DISULFID 6..11: note = Intrachain disulfide bond
  DISULFID 7: note = Interchain disulfide bond with another sequence
  DISULFID 20: note = Interchain disulfide bond with another sequence
GIVEQCCTSICSLYQLENYCN

SEQ ID NO: 24070 - protein, 32 aa, synthetic construct
EAEDLQVGQVELGGGPGAGSLQPLALEGSLQR

SEQ ID NO: 24071 - protein, 97 aa, synthetic construct
  DISULFID 19..83: note = Intrachain disulfide bond
  DISULFID 31..96: note = Intrachain disulfide bond
  DISULFID 82..87: note = Intrachain disulfide bond
MIEGGRGKGSHKFVNQHLCGSHLVEALYLVCGKRGFFYTPRTRREAEDLQVGQVELGGGPGAGSLQPLALEGSLQRGIVEQCCTSICSLYQLENYCN

SEQ ID NO: 24072 - protein, 97 aa, synthetic construct; identical to SEQ ID NO: 24071
  DISULFID 19..83: note = Intrachain disulfide bond
  DISULFID 31..96: note = Intrachain disulfide bond
  DISULFID 82..87: note = Intrachain disulfide bond

SEQ ID NO: 24073 - protein, 21 aa, synthetic construct
  DISULFID 6..11: note = Intrachain disulfide bond
  DISULFID 7: note = Interchain disulfide bond with another sequence
  DISULFID 20: note = Interchain disulfide bond with another sequence
GIVEQCCTSICSLYQLENYCN

SEQ ID NO: 24074 - protein, 47 aa, synthetic construct; identical to SEQ ID NO: 24064
  DISULFID 25: note = Interchain disulfide bond with another sequence
  DISULFID 37: note = Interchain disulfide bond with another sequence

SEQ ID NO: 24075 - protein, 35 aa, synthetic construct
  DISULFID 13: note = Interchain disulfide bond with another sequence
  DISULFID 25: note = Interchain disulfide bond with another sequence
GKGSHKFVNQHLCGSHLVEALYLVCGKRGFFYTPR

SEQ ID NO: 24076-24999 - skipped (924 entries)

SEQ ID NO: 25000 - protein, 31 aa, synthetic construct
KFVNQHLCGSHLVEALYLVCGKRGFFYTRPT

SEQ ID NO: 25001 - protein, 31 aa, synthetic construct
KFVGQHLCGSHLVEALYLVCGKRGFFYTRPT

SEQ ID NO: 25002 - protein, 27 aa, synthetic construct
KHLCGSHLVEALYLVCGKRGFFYTRPT

SEQ ID NO: 25003 - protein, 30 aa, synthetic construct
KFVNQHLCGSHLVEALYLVCGKRGFFYTRP

SEQ ID NO: 25004 - protein, 30 aa, synthetic construct
KFVGQHLCGSHLVEALYLVCGKRGFFYTRP

SEQ ID NO: 25005 - protein, 26 aa, synthetic construct
KHLCGSHLVEALYLVCGKRGFFYTRP

SEQ ID NO: 25006 - protein, 30 aa, synthetic construct
KFVSQHLCGSHLVEALYLVCGKRGFFYTPR

SEQ ID NO: 25007 - protein, 30 aa, synthetic construct
KFVTQHLCGSHLVEALYLVCGKRGFFYTPR

SEQ ID NO: 25008 - protein, 30 aa, synthetic construct
KFVGQHLCGSHLVEALYLVCGKRGFFYTPR

SEQ ID NO: 25009 - protein, 30 aa, synthetic construct
KFVNQHLCGSHLVEALYLVCGKRGFFYTPR

SEQ ID NO: 25010 - protein, 26 aa, synthetic construct
KHLCGSHLVEALYLVCGKRGFFYTPR

SEQ ID NO: 25011 - protein, 31 aa, synthetic construct
KFVNQHLCGSHLVEALYLVCGERGFFYTKPT

SEQ ID NO: 25012 - protein, 31 aa, synthetic construct
KFVGQHLCGSHLVEALYLVCGERGFFYTKPT

SEQ ID NO: 25013 - protein, 27 aa, synthetic construct
KHLCGSHLVEALYLVCGERGFFYTKPT

SEQ ID NO: 25014 - protein, 30 aa, synthetic construct
KFVNQHLCGSHLVEALYLVCGERGFFYTKP

SEQ ID NO: 25015 - protein, 30 aa, synthetic construct
KFVGQHLCGSHLVEALYLVCGERGFFYTKP

SEQ ID NO: 25016 - protein, 26 aa, synthetic construct
KHLCGSHLVEALYLVCGERGFFYTKP

SEQ ID NO: 25017 - protein, 30 aa, synthetic construct
KFVSQHLCGSHLVEALYLVCGERGFFYTPK

SEQ ID NO: 25018 - protein, 30 aa, synthetic construct
KFVTQHLCGSHLVEALYLVCGERGFFYTPK

SEQ ID NO: 25019 - protein, 30 aa, synthetic construct
KFVGQHLCGSHLVEALYLVCGERGFFYTPK

SEQ ID NO: 25020 - protein, 30 aa, synthetic construct
KFVNQHLCGSHLVEALYLVCGERGFFYTPK

SEQ ID NO: 25021 - protein, 26 aa, synthetic construct
KHLCGSHLVEALYLVCGERGFFYTPK

SEQ ID NO: 25022 - protein, 31 aa, synthetic construct
KFVNQHLCGSHLVEALYLVCGDRGFFYTKPT

SEQ ID NO: 25023 - protein, 31 aa, synthetic construct
KFVGQHLCGSHLVEALYLVCGDRGFFYTKPT

SEQ ID NO: 25024 - protein, 27 aa, synthetic construct
KHLCGSHLVEALYLVCGDRGFFYTKPT

SEQ ID NO: 25025 - protein, 30 aa, synthetic construct
KFVNQHLCGSHLVEALYLVCGDRGFFYTKP

SEQ ID NO: 25026 - protein, 30 aa, synthetic construct
KFVGQHLCGSHLVEALYLVCGDRGFFYTKP

SEQ ID NO: 25027 - protein, 26 aa, synthetic construct
KHLCGSHLVEALYLVCGDRGFFYTKP

SEQ ID NO: 25028 - protein, 30 aa, synthetic construct
KFVSQHLCGSHLVEALYLVCGDRGFFYTPK

SEQ ID NO: 25029 - protein, 30 aa, synthetic construct
KFVTQHLCGSHLVEALYLVCGDRGFFYTPK

SEQ ID NO: 25030 - protein, 30 aa, synthetic construct
KFVGQHLCGSHLVEALYLVCGDRGFFYTPK

SEQ ID NO: 25031 - protein, 30 aa, synthetic construct
KFVNQHLCGSHLVEALYLVCGDRGFFYTPK

SEQ ID NO: 25032 - protein, 26 aa, synthetic construct
KHLCGSHLVEALYLVCGDRGFFYTPK

SEQ ID NO: 25033 - protein, 31 aa, synthetic construct
KFVNQHLCGSHLVEALHLVCGKRGFFYTRPT

SEQ ID NO: 25034 - protein, 31 aa, synthetic construct
KFVGQHLCGSHLVEALHLVCGKRGFFYTRPT

SEQ ID NO: 25035 - protein, 27 aa, synthetic construct
KHLCGSHLVEALHLVCGKRGFFYTRPT

SEQ ID NO: 25036 - protein, 30 aa, synthetic construct
KFVNQHLCGSHLVEALHLVCGKRGFFYTRP

SEQ ID NO: 25037 - protein, 30 aa, synthetic construct
KFVGQHLCGSHLVEALHLVCGKRGFFYTRP

SEQ ID NO: 25038 - protein, 26 aa, synthetic construct
KHLCGSHLVEALHLVCGKRGFFYTRP

SEQ ID NO: 25039 - protein, 30 aa, synthetic construct
KFVSQHLCGSHLVEALHLVCGKRGFFYTPR

SEQ ID NO: 25040 - protein, 30 aa, synthetic construct
KFVTQHLCGSHLVEALHLVCGKRGFFYTPR

SEQ ID NO: 25041 - protein, 30 aa, synthetic construct
KFVGQHLCGSHLVEALHLVCGKRGFFYTPR

SEQ ID NO: 25042 - protein, 30 aa, synthetic construct
KFVNQHLCGSHLVEALHLVCGKRGFFYTPR

SEQ ID NO: 25043 - protein, 26 aa, synthetic construct
KHLCGSHLVEALHLVCGKRGFFYTPR

SEQ ID NO: 25044 - protein, 31 aa, synthetic construct
KFVGQHLCGSHLVEALHLVCGDRGFFYTKPT

SEQ ID NO: 25045 - protein, 27 aa, synthetic construct
KHLCGSHLVEALHLVCGDRGFFYTKPT

SEQ ID NO: 25046 - protein, 30 aa, synthetic construct
KFVNQHLCGSHLVEALHLVCGDRGFFYTKP

SEQ ID NO: 25047 - protein, 30 aa, synthetic construct
KFVGQHLCGSHLVEALHLVCGDRGFFYTKP

SEQ ID NO: 25048 - protein, 26 aa, synthetic construct
KHLCGSHLVEALHLVCGDRGFFYTKP

SEQ ID NO: 25049 - protein, 30 aa, synthetic construct
KFVSQHLCGSHLVEALHLVCGDRGFFYTPK

SEQ ID NO: 25050 - protein, 30 aa, synthetic construct
KFVTQHLCGSHLVEALHLVCGDRGFFYTPK

SEQ ID NO: 25051 - protein, 30 aa, synthetic construct
KFVGQHLCGSHLVEALHLVCGDRGFFYTPK

SEQ ID NO: 25052 - protein, 30 aa, synthetic construct
KFVNQHLCGSHLVEALHLVCGDRGFFYTPK

SEQ ID NO: 25053 - protein, 26 aa, synthetic construct
KHLCGSHLVEALHLVCGDRGFFYTPK

SEQ ID NO: 25054 - protein, 31 aa, synthetic construct
KFVNQHLCGSHLVEALHLVCGKRGFHYTRPT

SEQ ID NO: 25055 - protein, 31 aa, synthetic construct
KFVGQHLCGSHLVEALHLVCGKRGFHYTRPT

SEQ ID NO: 25056 - protein, 27 aa, synthetic construct
KHLCGSHLVEALHLVCGKRGFHYTRPT

SEQ ID NO: 25057 - protein, 30 aa, synthetic construct
KFVNQHLCGSHLVEALHLVCGKRGFHYTRP

SEQ ID NO: 25058 - protein, 30 aa, synthetic construct
KFVGQHLCGSHLVEALHLVCGKRGFHYTRP

SEQ ID NO: 25059 - protein, 26 aa, synthetic construct
KHLCGSHLVEALHLVCGKRGFHYTRP

SEQ ID NO: 25060 - protein, 30 aa, synthetic construct
KFVSQHLCGSHLVEALHLVCGKRGFHYTPR

SEQ ID NO: 25061 - protein, 30 aa, synthetic construct
KFVTQHLCGSHLVEALHLVCGKRGFHYTPR

SEQ ID NO: 25062 - protein, 30 aa, synthetic construct
KFVGQHLCGSHLVEALHLVCGKRGFHYTPR

SEQ ID NO: 25063 - protein, 30 aa, synthetic construct
KFVNQHLCGSHLVEALHLVCGKRGFHYTPR

SEQ ID NO: 25064 - protein, 26 aa, synthetic construct
KHLCGSHLVEALHLVCGKRGFHYTPR

SEQ ID NO: 25065 - protein, 31 aa, synthetic construct
KFVNQHLCGSHLVEALHLVCGDRGFHYTKPT

SEQ ID NO: 25066 - protein, 31 aa, synthetic construct
KFVGQHLCGSHLVEALHLVCGDRGFHYTKPT

SEQ ID NO: 25067 - protein, 27 aa, synthetic construct
KHLCGSHLVEALHLVCGDRGFHYTKPT

SEQ ID NO: 25068 - protein, 30 aa, synthetic construct
KFVNQHLCGSHLVEALHLVCGDRGFHYTKP

SEQ ID NO: 25069 - protein, 30 aa, synthetic construct
KFVGQHLCGSHLVEALHLVCGDRGFHYTKP

SEQ ID NO: 25070 - protein, 26 aa, synthetic construct
KHLCGSHLVEALHLVCGDRGFHYTKP

SEQ ID NO: 25071 - protein, 30 aa, synthetic construct
KFVSQHLCGSHLVEALHLVCGDRGFHYTPK

SEQ ID NO: 25072 - protein, 30 aa, synthetic construct
KFVTQHLCGSHLVEALHLVCGDRGFHYTPK

SEQ ID NO: 25073 - protein, 30 aa, synthetic construct
KFVGQHLCGSHLVEALHLVCGDRGFHYTPK

SEQ ID NO: 25074 - protein, 30 aa, synthetic construct
KFVNQHLCGSHLVEALHLVCGDRGFHYTPK

SEQ ID NO: 25075 - protein, 26 aa, synthetic construct
KHLCGSHLVEALHLVCGDRGFHYTPK

SEQ ID NO: 25076 - protein, 49 aa, synthetic construct
KGSHGGGGSGGGGSGGGGSFVNQHLCGSHLVEALYLVCGKRGFFYTRPT

SEQ ID NO: 25077 - protein, 49 aa, synthetic construct
KGSHGGGGSGGGGSGGGGSFVGQHLCGSHLVEALYLVCGKRGFFYTRPT

SEQ ID NO: 25078 - protein, 45 aa, synthetic construct
KGSHGGGGSGGGGSGGGGSHLCGSHLVEALYLVCGKRGFFYTRPT

SEQ ID NO: 25079 - protein, 48 aa, synthetic construct
KGSHGGGGSGGGGSGGGGSFVNQHLCGSHLVEALYLVCGKRGFFYTRP

SEQ ID NO: 25080 - protein, 48 aa, synthetic construct
KGSHGGGGSGGGGSGGGGSFVGQHLCGSHLVEALYLVCGKRGFFYTRP

SEQ ID NO: 25081 - protein, 44 aa, synthetic construct
KGSHGGGGSGGGGSGGGGSHLCGSHLVEALYLVCGKRGFFYTRP

SEQ ID NO: 25082 - protein, 48 aa, synthetic construct
KGSHGGGGSGGGGSGGGGSFVSQHLCGSHLVEALYLVCGKRGFFYTPR

SEQ ID NO: 25083 - protein, 48 aa, synthetic construct
KGSHGGGGSGGGGSGGGGSFVTQHLCGSHLVEALYLVCGKRGFFYTPR

SEQ ID NO: 25084 - protein, 48 aa, synthetic construct
KGSHGGGGSGGGGSGGGGSFVGQHLCGSHLVEALYLVCGKRGFFYTPR

SEQ ID NO: 25085 - protein, 48 aa, synthetic construct
KGSHGGGGSGGGGSGGGGSFVNQHLCGSHLVEALYLVCGKRGFFYTPR

SEQ ID NO: 25086 - protein, 44 aa, synthetic construct
KGSHGGGGSGGGGSGGGGSHLCGSHLVEALYLVCGKRGFFYTPR

SEQ ID NO: 25087 - protein, 49 aa, synthetic construct
KGSHGGGGSGGGGSGGGGSFVNQHLCGSHLVEALYLVCGERGFFYTKPT

SEQ ID NO: 25088 - protein, 49 aa, synthetic construct
KGSHGGGGSGGGGSGGGGSFVGQHLCGSHLVEALYLVCGERGFFYTKPT

SEQ ID NO: 25089 - protein, 45 aa, synthetic construct
KGSHGGGGSGGGGSGGGGSHLCGSHLVEALYLVCGERGFFYTKPT

SEQ ID NO: 25090 - protein, 48 aa, synthetic construct
KGSHGGGGSGGGGSGGGGSFVNQHLCGSHLVEALYLVCGERGFFYTKP

SEQ ID NO: 25091 - protein, 48 aa, synthetic construct
KGSHGGGGSGGGGSGGGGSFVGQHLCGSHLVEALYLVCGERGFFYTKP

SEQ ID NO: 25092 - protein, 44 aa, synthetic construct
KGSHGGGGSGGGGSGGGGSHLCGSHLVEALYLVCGERGFFYTKP

SEQ ID NO: 25093 - protein, 48 aa, synthetic construct
KGSHGGGGSGGGGSGGGGSFVSQHLCGSHLVEALYLVCGERGFFYTPK

SEQ ID NO: 25094 - protein, 48 aa, synthetic construct
KGSHGGGGSGGGGSGGGGSFVTQHLCGSHLVEALYLVCGERGFFYTPK

SEQ ID NO: 25095 - protein, 48 aa, synthetic construct
KGSHGGGGSGGGGSGGGGSFVGQHLCGSHLVEALYLVCGERGFFYTPK

SEQ ID NO: 25096 - protein, 48 aa, synthetic construct
KGSHGGGGSGGGGSGGGGSFVNQHLCGSHLVEALYLVCGERGFFYTPK

SEQ ID NO: 25097 - protein, 44 aa, synthetic construct
KGSHGGGGSGGGGSGGGGSHLCGSHLVEALYLVCGERGFFYTPK

SEQ ID NO: 25098 - protein, 49 aa, synthetic construct
KGSHGGGGSGGGGSGGGGSFVNQHLCGSHLVEALYLVCGDRGFFYTKPT

SEQ ID NO: 25099 - protein, 49 aa, synthetic construct
KGSHGGGGSGGGGSGGGGSFVGQHLCGSHLVEALYLVCGDRGFFYTKPT

SEQ ID NO: 25100 - protein, 45 aa, synthetic construct
KGSHGGGGSGGGGSGGGGSHLCGSHLVEALYLVCGDRGFFYTKPT

SEQ ID NO: 25101 - protein, 48 aa, synthetic construct
KGSHGGGGSGGGGSGGGGSFVNQHLCGSHLVEALYLVCGDRGFFYTKP

SEQ ID NO: 25102 - protein, 48 aa, synthetic construct
KGSHGGGGSGGGGSGGGGSFVGQHLCGSHLVEALYLVCGDRGFFYTKP

SEQ ID NO: 25103 - protein, 44 aa, synthetic construct
KGSHGGGGSGGGGSGGGGSHLCGSHLVEALYLVCGDRGFFYTKP

SEQ ID NO: 25104 - protein, 48 aa, synthetic construct
KGSHGGGGSGGGGSGGGGSFVSQHLCGSHLVEALYLVCGDRGFFYTPK

SEQ ID NO: 25105 - protein, 48 aa, synthetic construct
KGSHGGGGSGGGGSGGGGSFVTQHLCGSHLVEALYLVCGDRGFFYTPK

SEQ ID NO: 25106 - protein, 48 aa, synthetic construct
KGSHGGGGSGGGGSGGGGSFVGQHLCGSHLVEALYLVCGDRGFFYTPK

SEQ ID NO: 25107 - protein, 48 aa, synthetic construct
KGSHGGGGSGGGGSGGGGSFVNQHLCGSHLVEALYLVCGDRGFFYTPK

SEQ ID NO: 25108 - protein, 44 aa, synthetic construct
KGSHGGGGSGGGGSGGGGSHLCGSHLVEALYLVCGDRGFFYTPK

SEQ ID NO: 25109 - protein, 49 aa, synthetic construct
KGSHGGGGSGGGGSGGGGSFVNQHLCGSHLVEALHLVCGKRGFFYTRPT

SEQ ID NO: 25110 - protein, 49 aa, synthetic construct
KGSHGGGGSGGGGSGGGGSFVGQHLCGSHLVEALHLVCGKRGFFYTRPT

SEQ ID NO: 25111 - protein, 45 aa, synthetic construct
KGSHGGGGSGGGGSGGGGSHLCGSHLVEALHLVCGKRGFFYTRPT

SEQ ID NO: 25112 - protein, 48 aa, synthetic construct
KGSHGGGGSGGGGSGGGGSFVNQHLCGSHLVEALHLVCGKRGFFYTRP

SEQ ID NO: 25113 - protein, 48 aa, synthetic construct
KGSHGGGGSGGGGSGGGGSFVGQHLCGSHLVEALHLVCGKRGFFYTRP

SEQ ID NO: 25114 - protein, 44 aa, synthetic construct
KGSHGGGGSGGGGSGGGGSHLCGSHLVEALHLVCGKRGFFYTRP

SEQ ID NO: 25115 - protein, 48 aa, synthetic construct
KGSHGGGGSGGGGSGGGGSFVSQHLCGSHLVEALHLVCGKRGFFYTPR

SEQ ID NO: 25116 - protein, 48 aa, synthetic construct
KGSHGGGGSGGGGSGGGGSFVTQHLCGSHLVEALHLVCGKRGFFYTPR

SEQ ID NO: 25117 - protein, 48 aa, synthetic construct
KGSHGGGGSGGGGSGGGGSFVGQHLCGSHLVEALHLVCGKRGFFYTPR

SEQ ID NO: 25118 - protein, 48 aa, synthetic construct
KGSHGGGGSGGGGSGGGGSFVNQHLCGSHLVEALHLVCGKRGFFYTPR

SEQ ID NO: 25119 - protein, 44 aa, synthetic construct
KGSHGGGGSGGGGSGGGGSHLCGSHLVEALHLVCGKRGFFYTPR

SEQ ID NO: 25120 - protein, 49 aa, synthetic construct
KGSHGGGGSGGGGSGGGGSFVGQHLCGSHLVEALHLVCGDRGFFYTKPT

SEQ ID NO: 25121 - protein, 45 aa, synthetic construct
KGSHGGGGSGGGGSGGGGSHLCGSHLVEALHLVCGDRGFFYTKPT

SEQ ID NO: 25122 - protein, 48 aa, synthetic construct
KGSHGGGGSGGGGSGGGGSFVNQHLCGSHLVEALHLVCGDRGFFYTKP

SEQ ID NO: 25123 - protein, 48 aa, synthetic construct
KGSHGGGGSGGGGSGGGGSFVGQHLCGSHLVEALHLVCGDRGFFYTKP

SEQ ID NO: 25124 - protein, 44 aa, synthetic construct
KGSHGGGGSGGGGSGGGGSHLCGSHLVEALHLVCGDRGFFYTKP

SEQ ID NO: 25125 - protein, 48 aa, synthetic construct
KGSHGGGGSGGGGSGGGGSFVSQHLCGSHLVEALHLVCGDRGFFYTPK

SEQ ID NO: 25126 - protein, 48 aa, synthetic construct
KGSHGGGGSGGGGSGGGGSFVTQHLCGSHLVEALHLVCGDRGFFYTPK

SEQ ID NO: 25127 - protein, 48 aa, synthetic construct
KGSHGGGGSGGGGSGGGGSFVGQHLCGSHLVEALHLVCGDRGFFYTPK

SEQ ID NO: 25128 - protein, 48 aa, synthetic construct
KGSHGGGGSGGGGSGGGGSFVNQHLCGSHLVEALHLVCGDRGFFYTPK

SEQ ID NO: 25129 - protein, 44 aa, synthetic construct
KGSHGGGGSGGGGSGGGGSHLCGSHLVEALHLVCGDRGFFYTPK

SEQ ID NO: 25130 - protein, 49 aa, synthetic construct
KGSHGGGGSGGGGSGGGGSFVNQHLCGSHLVEALHLVCGKRGFHYTRPT

SEQ ID NO: 25131 - protein, 49 aa, synthetic construct
KGSHGGGGSGGGGSGGGGSFVGQHLCGSHLVEALHLVCGKRGFHYTRPT

SEQ ID NO: 25132 - protein, 45 aa, synthetic construct
KGSHGGGGSGGGGSGGGGSHLCGSHLVEALHLVCGKRGFHYTRPT

SEQ ID NO: 25133 - protein, 48 aa, synthetic construct
KGSHGGGGSGGGGSGGGGSFVNQHLCGSHLVEALHLVCGKRGFHYTRP

SEQ ID NO: 25134 - protein, 48 aa, synthetic construct
KGSHGGGGSGGGGSGGGGSFVGQHLCGSHLVEALHLVCGKRGFHYTRP

SEQ ID NO: 25135 - protein, 44 aa, synthetic construct
KGSHGGGGSGGGGSGGGGSHLCGSHLVEALHLVCGKRGFHYTRP

SEQ ID NO: 25136 - protein, 48 aa, synthetic construct
KGSHGGGGSGGGGSGGGGSFVSQHLCGSHLVEALHLVCGKRGFHYTPR

SEQ ID NO: 25137 - protein, 48 aa, synthetic construct
KGSHGGGGSGGGGSGGGGSFVTQHLCGSHLVEALHLVCGKRGFHYTPR

SEQ ID NO: 25138 - protein, 48 aa, synthetic construct
KGSHGGGGSGGGGSGGGGSFVGQHLCGSHLVEALHLVCGKRGFHYTPR

SEQ ID NO: 25139 - protein, 48 aa, synthetic construct
KGSHGGGGSGGGGSGGGGSFVNQHLCGSHLVEALHLVCGKRGFHYTPR

SEQ ID NO: 25140 - protein, 44 aa, synthetic construct
KGSHGGGGSGGGGSGGGGSHLCGSHLVEALHLVCGKRGFHYTPR

SEQ ID NO: 25141 - protein, 49 aa, synthetic construct
KGSHGGGGSGGGGSGGGGSFVNQHLCGSHLVEALHLVCGDRGFHYTKPT

SEQ ID NO: 25142 - protein, 49 aa, synthetic construct
KGSHGGGGSGGGGSGGGGSFVGQHLCGSHLVEALHLVCGDRGFHYTKPT

SEQ ID NO: 25143 - protein, 45 aa, synthetic construct
KGSHGGGGSGGGGSGGGGSHLCGSHLVEALHLVCGDRGFHYTKPT

SEQ ID NO: 25144 - protein, 48 aa, synthetic construct
KGSHGGGGSGGGGSGGGGSFVNQHLCGSHLVEALHLVCGDRGFHYTKP

SEQ ID NO: 25145 - protein, 48 aa, synthetic construct
KGSHGGGGSGGGGSGGGGSFVGQHLCGSHLVEALHLVCGDRGFHYTKP

SEQ ID NO: 25146 - protein, 44 aa, synthetic construct
KGSHGGGGSGGGGSGGGGSHLCGSHLVEALHLVCGDRGFHYTKP

SEQ ID NO: 25147 - protein, 48 aa, synthetic construct
KGSHGGGGSGGGGSGGGGSFVSQHLCGSHLVEALHLVCGDRGFHYTPK

SEQ ID NO: 25148 - protein, 48 aa, synthetic construct
KGSHGGGGSGGGGSGGGGSFVTQHLCGSHLVEALHLVCGDRGFHYTPK

SEQ ID NO: 25149 - protein, 48 aa, synthetic construct
KGSHGGGGSGGGGSGGGGSFVGQHLCGSHLVEALHLVCGDRGFHYTPK

SEQ ID NO: 25150 - protein, 48 aa, synthetic construct
KGSHGGGGSGGGGSGGGGSFVNQHLCGSHLVEALHLVCGDRGFHYTPK

SEQ ID NO: 25151 - protein, 44 aa, synthetic construct
KGSHGGGGSGGGGSGGGGSHLCGSHLVEALHLVCGDRGFHYTPK

SEQ ID NO: 25152 - protein, 54 aa, synthetic construct
KGSHGGGGSGGGGSGGGGSGGGGSFVNQHLCGSHLVEALYLVCGKRGFFYTRPT

SEQ ID NO: 25153 - protein, 54 aa, synthetic construct
KGSHGGGGSGGGGSGGGGSGGGGSFVGQHLCGSHLVEALYLVCGKRGFFYTRPT

SEQ ID NO: 25154 - protein, 50 aa, synthetic construct
KGSHGGGGSGGGGSGGGGSGGGGSHLCGSHLVEALYLVCGKRGFFYTRPT

SEQ ID NO: 25155 - protein, 53 aa, synthetic construct
KGSHGGGGSGGGGSGGGGSGGGGSFVNQHLCGSHLVEALYLVCGKRGFFYTRP

SEQ ID NO: 25156 - protein, 53 aa, synthetic construct
KGSHGGGGSGGGGSGGGGSGGGGSFVGQHLCGSHLVEALYLVCGKRGFFYTRP

SEQ ID NO: 25157 - protein, 49 aa, synthetic construct
KGSHGGGGSGGGGSGGGGSGGGGSHLCGSHLVEALYLVCGKRGFFYTRP

SEQ ID NO: 25158 - protein, 53 aa, synthetic construct
KGSHGGGGSGGGGSGGGGSGGGGSFVSQHLCGSHLVEALYLVCGKRGFFYTPR

SEQ ID NO: 25159 - protein, 53 aa, synthetic construct
KGSHGGGGSGGGGSGGGGSGGGGSFVTQHLCGSHLVEALYLVCGKRGFFYTPR

SEQ ID NO: 25160 - protein, 53 aa, synthetic construct
KGSHGGGGSGGGGSGGGGSGGGGSFVGQHLCGSHLVEALYLVCGKRGFFYTPR

SEQ ID NO: 25161 - protein, 53 aa, synthetic construct
KGSHGGGGSGGGGSGGGGSGGGGSFVNQHLCGSHLVEALYLVCGKRGFFYTPR

SEQ ID NO: 25162 - protein, 49 aa, synthetic construct
KGSHGGGGSGGGGSGGGGSGGGGSHLCGSHLVEALYLVCGKRGFFYTPR

SEQ ID NO: 25163 - protein, 54 aa, synthetic construct
KGSHGGGGSGGGGSGGGGSGGGGSFVNQHLCGSHLVEALYLVCGERGFFYTKPT

SEQ ID NO: 25164 - protein, 54 aa, synthetic construct
KGSHGGGGSGGGGSGGGGSGGGGSFVGQHLCGSHLVEALYLVCGERGFFYTKPT

SEQ ID NO: 25165 - protein, 50 aa, synthetic construct
KGSHGGGGSGGGGSGGGGSGGGGSHLCGSHLVEALYLVCGERGFFYTKPT

SEQ ID NO: 25166 - protein, 53 aa, synthetic construct
KGSHGGGGSGGGGSGGGGSGGGGSFVNQHLCGSHLVEALYLVCGERGFFYTKP

SEQ ID NO: 25167 - protein, 53 aa, synthetic construct
KGSHGGGGSGGGGSGGGGSGGGGSFVGQHLCGSHLVEALYLVCGERGFFYTKP

SEQ ID NO: 25168 - protein, 49 aa, synthetic construct
KGSHGGGGSGGGGSGGGGSGGGGSHLCGSHLVEALYLVCGERGFFYTKP

SEQ ID NO: 25169 - protein, 53 aa, synthetic construct
KGSHGGGGSGGGGSGGGGSGGGGSFVSQHLCGSHLVEALYLVCGERGFFYTPK

SEQ ID NO: 25170 - protein, 53 aa, synthetic construct
KGSHGGGGSGGGGSGGGGSGGGGSFVTQHLCGSHLVEALYLVCGERGFFYTPK

SEQ ID NO: 25171 - protein, 53 aa, synthetic construct
KGSHGGGGSGGGGSGGGGSGGGGSFVGQHLCGSHLVEALYLVCGERGFFYTPK

SEQ ID NO: 25172 - protein, 53 aa, synthetic construct
KGSHGGGGSGGGGSGGGGSGGGGSFVNQHLCGSHLVEALYLVCGERGFFYTPK

SEQ ID NO: 25173 - protein, 49 aa, synthetic construct
KGSHGGGGSGGGGSGGGGSGGGGSHLCGSHLVEALYLVCGERGFFYTPK

SEQ ID NO: 25174 - protein, 54 aa, synthetic construct
KGSHGGGGSGGGGSGGGGSGGGGSFVNQHLCGSHLVEALYLVCGDRGFFYTKPT

SEQ ID NO: 25175 - protein, 54 aa, synthetic construct
KGSHGGGGSGGGGSGGGGSGGGGSFVGQHLCGSHLVEALYLVCGDRGFFYTKPT

SEQ ID NO: 25176 - protein, 50 aa, synthetic construct
KGSHGGGGSGGGGSGGGGSGGGGSHLCGSHLVEALYLVCGDRGFFYTKPT

SEQ ID NO: 25177 - protein, 53 aa, synthetic construct
KGSHGGGGSGGGGSGGGGSGGGGSFVNQHLCGSHLVEALYLVCGDRGFFYTKP

SEQ ID NO: 25178 - protein, 53 aa, synthetic construct
KGSHGGGGSGGGGSGGGGSGGGGSFVGQHLCGSHLVEALYLVCGDRGFFYTKP

SEQ ID NO: 25179 - protein, 49 aa, synthetic construct
KGSHGGGGSGGGGSGGGGSGGGGSHLCGSHLVEALYLVCGDRGFFYTKP

SEQ ID NO: 25180 - protein, 53 aa, synthetic construct
KGSHGGGGSGGGGSGGGGSGGGGSFVSQHLCGSHLVEALYLVCGDRGFFYTPK

SEQ ID NO: 25181 - protein, 53 aa, synthetic construct
KGSHGGGGSGGGGSGGGGSGGGGSFVTQHLCGSHLVEALYLVCGDRGFFYTPK

SEQ ID NO: 25182 - protein, 53 aa, synthetic construct
KGSHGGGGSGGGGSGGGGSGGGGSFVGQHLCGSHLVEALYLVCGDRGFFYTPK

SEQ ID NO: 25183 - protein, 53 aa, synthetic construct
KGSHGGGGSGGGGSGGGGSGGGGSFVNQHLCGSHLVEALYLVCGDRGFFYTPK

SEQ ID NO: 25184 - protein, 49 aa, synthetic construct
KGSHGGGGSGGGGSGGGGSGGGGSHLCGSHLVEALYLVCGDRGFFYTPK

SEQ ID NO: 25185 - protein, 54 aa, synthetic construct
KGSHGGGGSGGGGSGGGGSGGGGSFVNQHLCGSHLVEALHLVCGKRGFFYTRPT

SEQ ID NO: 25186 - protein, 54 aa, synthetic construct
KGSHGGGGSGGGGSGGGGSGGGGSFVGQHLCGSHLVEALHLVCGKRGFFYTRPT

SEQ ID NO: 25187 - protein, 50 aa, synthetic construct
KGSHGGGGSGGGGSGGGGSGGGGSHLCGSHLVEALHLVCGKRGFFYTRPT

SEQ ID NO: 25188 - protein, 53 aa, synthetic construct
KGSHGGGGSGGGGSGGGGSGGGGSFVNQHLCGSHLVEALHLVCGKRGFFYTRP

SEQ ID NO: 25189 - protein, 53 aa, synthetic construct
KGSHGGGGSGGGGSGGGGSGGGGSFVGQHLCGSHLVEALHLVCGKRGFFYTRP

SEQ ID NO: 25190 - protein, 49 aa, synthetic construct
KGSHGGGGSGGGGSGGGGSGGGGSHLCGSHLVEALHLVCGKRGFFYTRP

SEQ ID NO: 25191 - protein, 53 aa, synthetic construct
KGSHGGGGSGGGGSGGGGSGGGGSFVSQHLCGSHLVEALHLVCGKRGFFYTPR

SEQ ID NO: 25192 - protein, 53 aa, synthetic construct
KGSHGGGGSGGGGSGGGGSGGGGSFVTQHLCGSHLVEALHLVCGKRGFFYTPR

SEQ ID NO: 25193 - protein, 53 aa, synthetic construct
KGSHGGGGSGGGGSGGGGSGGGGSFVGQHLCGSHLVEALHLVCGKRGFFYTPR

SEQ ID NO: 25194 - protein, 53 aa, synthetic construct
KGSHGGGGSGGGGSGGGGSGGGGSFVNQHLCGSHLVEALHLVCGKRGFFYTPR

SEQ ID NO: 25195 - protein, 49 aa, synthetic construct
KGSHGGGGSGGGGSGGGGSGGGGSHLCGSHLVEALHLVCGKRGFFYTPR

SEQ ID NO: 25196 - protein, 54 aa, synthetic construct
KGSHGGGGSGGGGSGGGGSGGGGSFVGQHLCGSHLVEALHLVCGDRGFFYTKPT

SEQ ID NO: 25197 - protein, 50 aa, synthetic construct
KGSHGGGGSGGGGSGGGGSGGGGSHLCGSHLVEALHLVCGDRGFFYTKPT

SEQ ID NO: 25198 - protein, 53 aa, synthetic construct
KGSHGGGGSGGGGSGGGGSGGGGSFVNQHLCGSHLVEALHLVCGDRGFFYTKP

SEQ ID NO: 25199 - protein, 53 aa, synthetic construct
KGSHGGGGSGGGGSGGGGSGGGGSFVGQHLCGSHLVEALHLVCGDRGFFYTKP

SEQ ID NO: 25200 - protein, 49 aa, synthetic construct
KGSHGGGGSGGGGSGGGGSGGGGSHLCGSHLVEALHLVCGDRGFFYTKP

SEQ ID NO: 25201 - protein, 53 aa, synthetic construct
KGSHGGGGSGGGGSGGGGSGGGGSFVSQHLCGSHLVEALHLVCGDRGFFYTPK

SEQ ID NO: 25202 - protein, 53 aa, synthetic construct
KGSHGGGGSGGGGSGGGGSGGGGSFVTQHLCGSHLVEALHLVCGDRGFFYTPK

SEQ ID NO: 25203 - protein, 53 aa, synthetic construct
KGSHGGGGSGGGGSGGGGSGGGGSFVGQHLCGSHLVEALHLVCGDRGFFYTPK

SEQ ID NO: 25204 - protein, 53 aa, synthetic construct
KGSHGGGGSGGGGSGGGGSGGGGSFVNQHLCGSHLVEALHLVCGDRGFFYTPK

SEQ ID NO: 25205 - protein, 49 aa, synthetic construct
KGSHGGGGSGGGGSGGGGSGGGGSHLCGSHLVEALHLVCGDRGFFYTPK

SEQ ID NO: 25206 - protein, 54 aa, synthetic construct
KGSHGGGGSGGGGSGGGGSGGGGSFVNQHLCGSHLVEALHLVCGKRGFHYTRPT

SEQ ID NO: 25207 - protein, 54 aa, synthetic construct
KGSHGGGGSGGGGSGGGGSGGGGSFVGQHLCGSHLVEALHLVCGKRGFHYTRPT

SEQ ID NO: 25208 - protein, 50 aa, synthetic construct
KGSHGGGGSGGGGSGGGGSGGGGSHLCGSHLVEALHLVCGKRGFHYTRPT

SEQ ID NO: 25209 - protein, 53 aa, synthetic construct
KGSHGGGGSGGGGSGGGGSGGGGSFVNQHLCGSHLVEALHLVCGKRGFHYTRP

SEQ ID NO: 25210 - protein, 53 aa, synthetic construct
KGSHGGGGSGGGGSGGGGSGGGGSFVGQHLCGSHLVEALHLVCGKRGFHYTRP

SEQ ID NO: 25211 - protein, 49 aa, synthetic construct
KGSHGGGGSGGGGSGGGGSGGGGSHLCGSHLVEALHLVCGKRGFHYTRP

SEQ ID NO: 25212 - protein, 53 aa, synthetic construct
KGSHGGGGSGGGGSGGGGSGGGGSFVSQHLCGSHLVEALHLVCGKRGFHYTPR

SEQ ID NO: 25213 - protein, 53 aa, synthetic construct
KGSHGGGGSGGGGSGGGGSGGGGSFVTQHLCGSHLVEALHLVCGKRGFHYTPR

SEQ ID NO: 25214 - protein, 53 aa, synthetic construct
KGSHGGGGSGGGGSGGGGSGGGGSFVGQHLCGSHLVEALHLVCGKRGFHYTPR

SEQ ID NO: 25215 - protein, 53 aa, synthetic construct
KGSHGGGGSGGGGSGGGGSGGGGSFVNQHLCGSHLVEALHLVCGKRGFHYTPR

SEQ ID NO: 25216 - protein, 49 aa, synthetic construct
KGSHGGGGSGGGGSGGGGSGGGGSHLCGSHLVEALHLVCGKRGFHYTPR

SEQ ID NO: 25217 - protein, 54 aa, synthetic construct
KGSHGGGGSGGGGSGGGGSGGGGSFVNQHLCGSHLVEALHLVCGDRGFHYTKPT

SEQ ID NO: 25218 - protein, 54 aa, synthetic construct
KGSHGGGGSGGGGSGGGGSGGGGSFVGQHLCGSHLVEALHLVCGDRGFHYTKPT

SEQ ID NO: 25219 - protein, 50 aa, synthetic construct
KGSHGGGGSGGGGSGGGGSGGGGSHLCGSHLVEALHLVCGDRGFHYTKPT

SEQ ID NO: 25220 - protein, 53 aa, synthetic construct
KGSHGGGGSGGGGSGGGGSGGGGSFVNQHLCGSHLVEALHLVCGDRGFHYTKP

SEQ ID NO: 25221 - protein, 53 aa, synthetic construct
KGSHGGGGSGGGGSGGGGSGGGGSFVGQHLCGSHLVEALHLVCGDRGFHYTKP

SEQ ID NO: 25222 - protein, 49 aa, synthetic construct
KGSHGGGGSGGGGSGGGGSGGGGSHLCGSHLVEALHLVCGDRGFHYTKP

SEQ ID NO: 25223 - protein, 53 aa, synthetic construct
KGSHGGGGSGGGGSGGGGSGGGGSFVSQHLCGSHLVEALHLVCGDRGFHYTPK

SEQ ID NO: 25224 - protein, 53 aa, synthetic construct
KGSHGGGGSGGGGSGGGGSGGGGSFVTQHLCGSHLVEALHLVCGDRGFHYTPK

SEQ ID NO: 25225 - protein, 53 aa, synthetic construct
KGSHGGGGSGGGGSGGGGSGGGGSFVGQHLCGSHLVEALHLVCGDRGFHYTPK

SEQ ID NO: 25226 - protein, 53 aa, synthetic construct
KGSHGGGGSGGGGSGGGGSGGGGSFVNQHLCGSHLVEALHLVCGDRGFHYTPK

SEQ ID NO: 25227 - protein, 49 aa, synthetic construct
KGSHGGGGSGGGGSGGGGSGGGGSHLCGSHLVEALHLVCGDRGFHYTPK

SEQ ID NO: 25228 - protein, 35 aa, synthetic construct; identical to SEQ ID NO: 24075

SEQ ID NO: 25229 - protein, 36 aa, synthetic construct
GKGSHKFVGQHLCGSHLVEALYLVCGKRGFFYTRPT

SEQ ID NO: 25230 - protein, 32 aa, synthetic construct
GKGSHKHLCGSHLVEALYLVCGKRGFFYTRPT

SEQ ID NO: 25231 - protein, 35 aa, synthetic construct
GKGSHKFVNQHLCGSHLVEALYLVCGKRGFFYTRP

SEQ ID NO: 25232 - protein, 35 aa, synthetic construct
GKGSHKFVGQHLCGSHLVEALYLVCGKRGFFYTRP

SEQ ID NO: 25233 - protein, 31 aa, synthetic construct
GKGSHKHLCGSHLVEALYLVCGKRGFFYTRP

SEQ ID NO: 25234 - protein, 35 aa, synthetic construct
GKGSHKFVSQHLCGSHLVEALYLVCGKRGFFYTPR

SEQ ID NO: 25235 - protein, 35 aa, synthetic construct
GKGSHKFVTQHLCGSHLVEALYLVCGKRGFFYTPR

SEQ ID NO: 25236 - protein, 35 aa, synthetic construct
GKGSHKFVGQHLCGSHLVEALYLVCGKRGFFYTPR

SEQ ID NO: 25237 - protein, 36 aa, synthetic construct
GKGSHKFVNQHLCGSHLVEALYLVCGKRGFFYTPRT

SEQ ID NO: 25238 - protein, 31 aa, synthetic construct
GKGSHKHLCGSHLVEALYLVCGKRGFFYTPR

SEQ ID NO: 25239 - protein, 36 aa, synthetic construct
GKGSHKFVNQHLCGSHLVEALYLVCGERGFFYTKPT

SEQ ID NO: 25240 - protein, 36 aa, synthetic construct
GKGSHKFVGQHLCGSHLVEALYLVCGERGFFYTKPT

SEQ ID NO: 25241 - protein, 32 aa, synthetic construct
GKGSHKHLCGSHLVEALYLVCGERGFFYTKPT

SEQ ID NO: 25242 - protein, 35 aa, synthetic construct
GKGSHKFVNQHLCGSHLVEALYLVCGERGFFYTKP

SEQ ID NO: 25243 - protein, 35 aa, synthetic construct
GKGSHKFVGQHLCGSHLVEALYLVCGERGFFYTKP

SEQ ID NO: 25244 - protein, 31 aa, synthetic construct
GKGSHKHLCGSHLVEALYLVCGERGFFYTKP

SEQ ID NO: 25245 - protein, 35 aa, synthetic construct
GKGSHKFVSQHLCGSHLVEALYLVCGERGFFYTPK

SEQ ID NO: 25246 - protein, 35 aa, synthetic construct
GKGSHKFVTQHLCGSHLVEALYLVCGERGFFYTPK

SEQ ID NO: 25247 - protein, 35 aa, synthetic construct
GKGSHKFVGQHLCGSHLVEALYLVCGERGFFYTPK

SEQ ID NO: 25248 - protein, 35 aa, synthetic construct
GKGSHKFVNQHLCGSHLVEALYLVCGERGFFYTPK

SEQ ID NO: 25249 - protein, 31 aa, synthetic construct
GKGSHKHLCGSHLVEALYLVCGERGFFYTPK

SEQ ID NO: 25250 - protein, 36 aa, synthetic construct
GKGSHKFVNQHLCGSHLVEALYLVCGDRGFFYTKPT

SEQ ID NO: 25251 - protein, 36 aa, synthetic construct
GKGSHKFVGQHLCGSHLVEALYLVCGDRGFFYTKPT

SEQ ID NO: 25252 - protein, 32 aa, synthetic construct
GKGSHKHLCGSHLVEALYLVCGDRGFFYTKPT

SEQ ID NO: 25253 - protein, 35 aa, synthetic construct
GKGSHKFVNQHLCGSHLVEALYLVCGDRGFFYTKP

SEQ ID NO: 25254 - protein, 35 aa, synthetic construct
GKGSHKFVGQHLCGSHLVEALYLVCGDRGFFYTKP

SEQ ID NO: 25255 - protein, 31 aa, synthetic construct
GKGSHKHLCGSHLVEALYLVCGDRGFFYTKP

SEQ ID NO: 25256 - protein, 35 aa, synthetic construct
GKGSHKFVSQHLCGSHLVEALYLVCGDRGFFYTPK

SEQ ID NO: 25257 - protein, 35 aa, synthetic construct
GKGSHKFVTQHLCGSHLVEALYLVCGDRGFFYTPK

SEQ ID NO: 25258 - protein, 35 aa, synthetic construct
GKGSHKFVGQHLCGSHLVEALYLVCGDRGFFYTPK

SEQ ID NO: 25259 - protein, 35 aa, synthetic construct
GKGSHKFVNQHLCGSHLVEALYLVCGDRGFFYTPK

SEQ ID NO: 25260 - protein, 31 aa, synthetic construct
GKGSHKHLCGSHLVEALYLVCGDRGFFYTPK

SEQ ID NO: 25261 - protein, 36 aa, synthetic construct
GKGSHKFVNQHLCGSHLVEALHLVCGKRGFFYTRPT

SEQ ID NO: 25262 - protein, 36 aa, synthetic construct
GKGSHKFVGQHLCGSHLVEALHLVCGKRGFFYTRPT

SEQ ID NO: 25263 - protein, 32 aa, synthetic construct
GKGSHKHLCGSHLVEALHLVCGKRGFFYTRPT

SEQ ID NO: 25264 - protein, 35 aa, synthetic construct
GKGSHKFVNQHLCGSHLVEALHLVCGKRGFFYTRP

SEQ ID NO: 25265 - protein, 35 aa, synthetic construct
GKGSHKFVGQHLCGSHLVEALHLVCGKRGFFYTRP

SEQ ID NO: 25266 - protein, 31 aa, synthetic construct
GKGSHKHLCGSHLVEALHLVCGKRGFFYTRP

SEQ ID NO: 25267 - protein, 35 aa, synthetic construct
GKGSHKFVSQHLCGSHLVEALHLVCGKRGFFYTPR

SEQ ID NO: 25268 - protein, 35 aa, synthetic construct
GKGSHKFVTQHLCGSHLVEALHLVCGKRGFFYTPR

SEQ ID NO: 25269 - protein, 35 aa, synthetic construct
GKGSHKFVGQHLCGSHLVEALHLVCGKRGFFYTPR

SEQ ID NO: 25270 - protein, 35 aa, synthetic construct
GKGSHKFVNQHLCGSHLVEALHLVCGKRGFFYTPR

SEQ ID NO: 25271 - protein, 31 aa, synthetic construct
GKGSHKHLCGSHLVEALHLVCGKRGFFYTPR

SEQ ID NO: 25272 - protein, 36 aa, synthetic construct
GKGSHKFVGQHLCGSHLVEALHLVCGDRGFFYTKPT

SEQ ID NO: 25273 - protein, 32 aa, synthetic construct
GKGSHKHLCGSHLVEALHLVCGDRGFFYTKPT

SEQ ID NO: 25274 - protein, 35 aa, synthetic construct
GKGSHKFVNQHLCGSHLVEALHLVCGDRGFFYTKP

SEQ ID NO: 25275 - protein, 35 aa, synthetic construct
GKGSHKFVGQHLCGSHLVEALHLVCGDRGFFYTKP

SEQ ID NO: 25276 - protein, 31 aa, synthetic construct
GKGSHKHLCGSHLVEALHLVCGDRGFFYTKP

SEQ ID NO: 25277 - protein, 35 aa, synthetic construct
GKGSHKFVSQHLCGSHLVEALHLVCGDRGFFYTPK

SEQ ID NO: 25278 - protein, 35 aa, synthetic construct
GKGSHKFVTQHLCGSHLVEALHLVCGDRGFFYTPK

SEQ ID NO: 25279 - protein, 35 aa, synthetic construct
GKGSHKFVGQHLCGSHLVEALHLVCGDRGFFYTPK

SEQ ID NO: 25280 - protein, 35 aa, synthetic construct
GKGSHKFVNQHLCGSHLVEALHLVCGDRGFFYTPK

SEQ ID NO: 25281 - protein, 31 aa, synthetic construct
GKGSHKHLCGSHLVEALHLVCGDRGFFYTPK

SEQ ID NO: 25282 - protein, 36 aa, synthetic construct
GKGSHKFVNQHLCGSHLVEALHLVCGKRGFHYTRPT

SEQ ID NO: 25283 - protein, 36 aa, synthetic construct
GKGSHKFVGQHLCGSHLVEALHLVCGKRGFHYTRPT

SEQ ID NO: 25284 - protein, 32 aa, synthetic construct
GKGSHKHLCGSHLVEALHLVCGKRGFHYTRPT

SEQ ID NO: 25285 - protein, 35 aa, synthetic construct
GKGSHKFVNQHLCGSHLVEALHLVCGKRGFHYTRP

SEQ ID NO: 25286 - protein, 35 aa, synthetic construct
GKGSHKFVGQHLCGSHLVEALHLVCGKRGFHYTRP

SEQ ID NO: 25287 - protein, 31 aa, synthetic construct
GKGSHKHLCGSHLVEALHLVCGKRGFHYTRP

SEQ ID NO: 25288 - protein, 35 aa, synthetic construct
GKGSHKFVSQHLCGSHLVEALHLVCGKRGFHYTPR

SEQ ID NO: 25289 - protein, 35 aa, synthetic construct
GKGSHKFVTQHLCGSHLVEALHLVCGKRGFHYTPR

SEQ ID NO: 25290 - protein, 35 aa, synthetic construct
GKGSHKFVGQHLCGSHLVEALHLVCGKRGFHYTPR

SEQ ID NO: 25291 - protein, 35 aa, synthetic construct
GKGSHKFVNQHLCGSHLVEALHLVCGKRGFHYTPR

SEQ ID NO: 25292 - protein, 31 aa, synthetic construct
GKGSHKHLCGSHLVEALHLVCGKRGFHYTPR

SEQ ID NO: 25293 - protein, 36 aa, synthetic construct
GKGSHKFVNQHLCGSHLVEALHLVCGDRGFHYTKPT

SEQ ID NO: 25294 - protein, 36 aa, synthetic construct
GKGSHKFVGQHLCGSHLVEALHLVCGDRGFHYTKPT

SEQ ID NO: 25295 - protein, 32 aa, synthetic construct
GKGSHKHLCGSHLVEALHLVCGDRGFHYTKPT

SEQ ID NO: 25296 - protein, 35 aa, synthetic construct
GKGSHKFVNQHLCGSHLVEALHLVCGDRGFHYTKP

SEQ ID NO: 25297 - protein, 35 aa, synthetic construct
GKGSHKFVGQHLCGSHLVEALHLVCGDRGFHYTKP

SEQ ID NO: 25298 - protein, 31 aa, synthetic construct
GKGSHKHLCGSHLVEALHLVCGDRGFHYTKP

SEQ ID NO: 25299 - protein, 35 aa, synthetic construct
GKGSHKFVSQHLCGSHLVEALHLVCGDRGFHYTPK

SEQ ID NO: 25300 - protein, 35 aa, synthetic construct
GKGSHKFVTQHLCGSHLVEALHLVCGDRGFHYTPK

SEQ ID NO: 25301 - protein, 35 aa, synthetic construct
GKGSHKFVGQHLCGSHLVEALHLVCGDRGFHYTPK

SEQ ID NO: 25302 - protein, 35 aa, synthetic construct
GKGSHKFVNQHLCGSHLVEALHLVCGDRGFHYTPK

SEQ ID NO: 25303 - protein, 31 aa, synthetic construct
GKGSHKHLCGSHLVEALHLVCGDRGFHYTPK

SEQ ID NO: 25304 - protein, 35 aa, synthetic construct
KGSHKFVNQHLCGSHLVEALYLVCGKRGFFYTRPT

SEQ ID NO: 25305 - protein, 35 aa, synthetic construct
KGSHKFVGQHLCGSHLVEALYLVCGKRGFFYTRPT

SEQ ID NO: 25306 - protein, 31 aa, synthetic construct
KGSHKHLCGSHLVEALYLVCGKRGFFYTRPT

SEQ ID NO: 25307 - protein, 34 aa, synthetic construct
KGSHKFVNQHLCGSHLVEALYLVCGKRGFFYTRP

SEQ ID NO: 25308 - protein, 34 aa, synthetic construct
KGSHKFVGQHLCGSHLVEALYLVCGKRGFFYTRP

SEQ ID NO: 25309 - protein, 30 aa, synthetic construct
KGSHKHLCGSHLVEALYLVCGKRGFFYTRP

SEQ ID NO: 25310 - protein, 34 aa, synthetic construct
KGSHKFVSQHLCGSHLVEALYLVCGKRGFFYTPR

SEQ ID NO: 25311 - protein, 34 aa, synthetic construct
KGSHKFVTQHLCGSHLVEALYLVCGKRGFFYTPR

SEQ ID NO: 25312 - protein, 34 aa, synthetic construct
KGSHKFVGQHLCGSHLVEALYLVCGKRGFFYTPR

SEQ ID NO: 25313 - protein, 34 aa, synthetic construct
KGSHKFVNQHLCGSHLVEALYLVCGKRGFFYTPR

SEQ ID NO: 25314 - protein, 30 aa, synthetic construct
KGSHKHLCGSHLVEALYLVCGKRGFFYTPR

SEQ ID NO: 25315 - protein, 35 aa, synthetic construct
KGSHKFVNQHLCGSHLVEALYLVCGERGFFYTKPT

SEQ ID NO: 25316 - protein, 35 aa, synthetic construct
KGSHKFVGQHLCGSHLVEALYLVCGERGFFYTKPT

SEQ ID NO: 25317 - protein, 31 aa, synthetic construct
KGSHKHLCGSHLVEALYLVCGERGFFYTKPT

SEQ ID NO: 25318 - protein, 34 aa, synthetic construct
KGSHKFVNQHLCGSHLVEALYLVCGERGFFYTKP

SEQ ID NO: 25319 - protein, 34 aa, synthetic construct
KGSHKFVGQHLCGSHLVEALYLVCGERGFFYTKP

SEQ ID NO: 25320 - protein, 30 aa, synthetic construct
KGSHKHLCGSHLVEALYLVCGERGFFYTKP

SEQ ID NO: 25321 - protein, 34 aa, synthetic construct
KGSHKFVSQHLCGSHLVEALYLVCGERGFFYTPK

SEQ ID NO: 25322 - protein, 34 aa, synthetic construct
KGSHKFVTQHLCGSHLVEALYLVCGERGFFYTPK

SEQ ID NO: 25323 - protein, 34 aa, synthetic construct
KGSHKFVGQHLCGSHLVEALYLVCGERGFFYTPK

SEQ ID NO: 25324 - protein, 34 aa, synthetic construct
KGSHKFVNQHLCGSHLVEALYLVCGERGFFYTPK

SEQ ID NO: 25325 - protein, 30 aa, synthetic construct
KGSHKHLCGSHLVEALYLVCGERGFFYTPK

SEQ ID NO: 25326 - protein, 35 aa, synthetic construct
KGSHKFVNQHLCGSHLVEALYLVCGDRGFFYTKPT

SEQ ID NO: 25327 - protein, 35 aa, synthetic construct
KGSHKFVGQHLCGSHLVEALYLVCGDRGFFYTKPT

SEQ ID NO: 25328 - protein, 31 aa, synthetic construct
KGSHKHLCGSHLVEALYLVCGDRGFFYTKPT

SEQ ID NO: 25329 - protein, 34 aa, synthetic construct
KGSHKFVNQHLCGSHLVEALYLVCGDRGFFYTKP

SEQ ID NO: 25330 - protein, 34 aa, synthetic construct
KGSHKFVGQHLCGSHLVEALYLVCGDRGFFYTKP

SEQ ID NO: 25331 - protein, 30 aa, synthetic construct
KGSHKHLCGSHLVEALYLVCGDRGFFYTKP

SEQ ID NO: 25332 - protein, 34 aa, synthetic construct
KGSHKFVSQHLCGSHLVEALYLVCGDRGFFYTPK

SEQ ID NO: 25333 - protein, 34 aa, synthetic construct
KGSHKFVTQHLCGSHLVEALYLVCGDRGFFYTPK

SEQ ID NO: 25334 - protein, 34 aa, synthetic construct
KGSHKFVGQHLCGSHLVEALYLVCGDRGFFYTPK

SEQ ID NO: 25335 - protein, 34 aa, synthetic construct
KGSHKFVNQHLCGSHLVEALYLVCGDRGFFYTPK

SEQ ID NO: 25336 - protein, 30 aa, synthetic construct
KGSHKHLCGSHLVEALYLVCGDRGFFYTPK

SEQ ID NO: 25337 - protein, 35 aa, synthetic construct
KGSHKFVNQHLCGSHLVEALHLVCGKRGFFYTRPT

SEQ ID NO: 25338 - protein, 35 aa, synthetic construct
KGSHKFVGQHLCGSHLVEALHLVCGKRGFFYTRPT

SEQ ID NO: 25339 - protein, 31 aa, synthetic construct
KGSHKHLCGSHLVEALHLVCGKRGFFYTRPT

SEQ ID NO: 25340 - protein, 34 aa, synthetic construct
KGSHKFVNQHLCGSHLVEALHLVCGKRGFFYTRP

SEQ ID NO: 25341 - protein, 34 aa, synthetic construct
KGSHKFVGQHLCGSHLVEALHLVCGKRGFFYTRP

SEQ ID NO: 25342 - protein, 30 aa, synthetic construct
KGSHKHLCGSHLVEALHLVCGKRGFFYTRP

SEQ ID NO: 25343 - protein, 34 aa, synthetic construct
KGSHKFVSQHLCGSHLVEALHLVCGKRGFFYTPR

SEQ ID NO: 25344 - protein, 34 aa, synthetic construct
KGSHKFVTQHLCGSHLVEALHLVCGKRGFFYTPR

SEQ ID NO: 25345 - protein, 34 aa, synthetic construct
KGSHKFVGQHLCGSHLVEALHLVCGKRGFFYTPR

SEQ ID NO: 25346 - protein, 34 aa, synthetic construct
KGSHKFVNQHLCGSHLVEALHLVCGKRGFFYTPR

SEQ ID NO: 25347 - protein, 30 aa, synthetic construct
KGSHKHLCGSHLVEALHLVCGKRGFFYTPR

SEQ ID NO: 25348 - protein, 35 aa, synthetic construct
KGSHKFVGQHLCGSHLVEALHLVCGDRGFFYTKPT

SEQ ID NO: 25349 - protein, 31 aa, synthetic construct
KGSHKHLCGSHLVEALHLVCGDRGFFYTKPT

SEQ ID NO: 25350 - protein, 34 aa, synthetic construct
KGSHKFVNQHLCGSHLVEALHLVCGDRGFFYTKP

SEQ ID NO: 25351 - protein, 34 aa, synthetic construct
KGSHKFVGQHLCGSHLVEALHLVCGDRGFFYTKP

SEQ ID NO: 25352 - protein, 30 aa, synthetic construct
KGSHKHLCGSHLVEALHLVCGDRGFFYTKP

SEQ ID NO: 25353 - protein, 34 aa, synthetic construct
KGSHKFVSQHLCGSHLVEALHLVCGDRGFFYTPK

SEQ ID NO: 25354 - protein, 34 aa, synthetic construct
KGSHKFVTQHLCGSHLVEALHLVCGDRGFFYTPK

SEQ ID NO: 25355 - protein, 34 aa, synthetic construct
KGSHKFVGQHLCGSHLVEALHLVCGDRGFFYTPK

SEQ ID NO: 25356 - protein, 34 aa, synthetic construct
KGSHKFVNQHLCGSHLVEALHLVCGDRGFFYTPK

SEQ ID NO: 25357 - protein, 30 aa, synthetic construct
KGSHKHLCGSHLVEALHLVCGDRGFFYTPK

SEQ ID NO: 25358 - protein, 35 aa, synthetic construct
KGSHKFVNQHLCGSHLVEALHLVCGKRGFHYTRPT

SEQ ID NO: 25359 - protein, 35 aa, synthetic construct
KGSHKFVGQHLCGSHLVEALHLVCGKRGFHYTRPT

SEQ ID NO: 25360 - protein, 31 aa, synthetic construct
KGSHKHLCGSHLVEALHLVCGKRGFHYTRPT

SEQ ID NO: 25361 - protein, 34 aa, synthetic construct
KGSHKFVNQHLCGSHLVEALHLVCGKRGFHYTRP

SEQ ID NO: 25362 - protein, 34 aa, synthetic construct
KGSHKFVGQHLCGSHLVEALHLVCGKRGFHYTRP

SEQ ID NO: 25363 - protein, 30 aa, synthetic construct
KGSHKHLCGSHLVEALHLVCGKRGFHYTRP

SEQ ID NO: 25364 - protein, 34 aa, synthetic construct
KGSHKFVSQHLCGSHLVEALHLVCGKRGFHYTPR

SEQ ID NO: 25365 - protein, 34 aa, synthetic construct
KGSHKFVTQHLCGSHLVEALHLVCGKRGFHYTPR

SEQ ID NO: 25366 - protein, 34 aa, synthetic construct
KGSHKFVGQHLCGSHLVEALHLVCGKRGFHYTPR

SEQ ID NO: 25367 - protein, 34 aa, synthetic construct
KGSHKFVNQHLCGSHLVEALHLVCGKRGFHYTPR

SEQ ID NO: 25368 - protein, 30 aa, synthetic construct
KGSHKHLCGSHLVEALHLVCGKRGFHYTPR

SEQ ID NO: 25369 - protein, 35 aa, synthetic construct
KGSHKFVNQHLCGSHLVEALHLVCGDRGFHYTKPT

SEQ ID NO: 25370 - protein, 35 aa, synthetic construct
KGSHKFVGQHLCGSHLVEALHLVCGDRGFHYTKPT

SEQ ID NO: 25371 - protein, 31 aa, synthetic construct
KGSHKHLCGSHLVEALHLVCGDRGFHYTKPT

SEQ ID NO: 25372 - protein, 34 aa, synthetic construct
KGSHKFVNQHLCGSHLVEALHLVCGDRGFHYTKP

SEQ ID NO: 25373 - protein, 34 aa, synthetic construct
KGSHKFVGQHLCGSHLVEALHLVCGDRGFHYTKP

SEQ ID NO: 25374 - protein, 30 aa, synthetic construct
KGSHKHLCGSHLVEALHLVCGDRGFHYTKP

SEQ ID NO: 25375 - protein, 34 aa, synthetic construct
KGSHKFVSQHLCGSHLVEALHLVCGDRGFHYTPK

SEQ ID NO: 25376 - protein, 34 aa, synthetic construct
KGSHKFVTQHLCGSHLVEALHLVCGDRGFHYTPK

SEQ ID NO: 25377 - protein, 34 aa, synthetic construct
KGSHKFVGQHLCGSHLVEALHLVCGDRGFHYTPK

SEQ ID NO: 25378 - protein, 34 aa, synthetic construct
KGSHKFVNQHLCGSHLVEALHLVCGDRGFHYTPK

SEQ ID NO: 25379 - protein, 30 aa, synthetic construct
KGSHKHLCGSHLVEALHLVCGDRGFHYTPK

SEQ ID NO: 25380 - protein, 35 aa, synthetic construct
KGSHKFVGQHLCGSHLVEALYLVCGKRGFFYTPRT

SEQ ID NO: 25381 - protein, 36 aa, synthetic construct
GKGSHKFVGQHLCGSHLVEALYLVCGKRGFFYTPRT

SEQ ID NO: 25382 - protein, 45 aa, synthetic construct
KGGGGSGGGGSGGGGSFVGQHLCGSHLVEALYLVCGERGFFYTPK

SEQ ID NO: 25383 - protein, 46 aa, synthetic construct
GKGGGGSGGGGSGGGGSFVGQHLCGSHLVEALYLVCGERGFFYTPK

SEQ ID NO: 25384 - protein, 46 aa, synthetic construct
KGGGGSGGGGSGGGGSFVGQHLCGSHLVEALYLVCGERGFFYTPKT

SEQ ID NO: 25385 - protein, 47 aa, synthetic construct
GKGGGGSGGGGSGGGGSFVGQHLCGSHLVEALYLVCGERGFFYTPKT

SEQ ID NO: 25386 - protein, 49 aa, synthetic construct
KGSHGGGGSGGGGSGGGGSFVGQHLCGSHLVEALYLVCGERGFFYTPKT

SEQ ID NO: 25387 - protein, 49 aa, synthetic construct
GKGSHGGGGSGGGGSGGGGSFVGQHLCGSHLVEALYLVCGERGFFYTPK

SEQ ID NO: 25388 - protein, 50 aa, synthetic construct
GKGSHGGGGSGGGGSGGGGSFVGQHLCGSHLVEALYLVCGERGFFYTPKT

SEQ ID NO: 25389 - protein, 45 aa, synthetic construct
KGGGGSGGGGSGGGGSFVGQHLCGSHLVEALYLVCGKRGFFYTPR

SEQ ID NO: 25390 - protein, 46 aa, synthetic construct
GKGGGGSGGGGSGGGGSFVGQHLCGSHLVEALYLVCGKRGFFYTPR

SEQ ID NO: 25391 - protein, 46 aa, synthetic construct
KGGGGSGGGGSGGGGSFVGQHLCGSHLVEALYLVCGKRGFFYTPRT

SEQ ID NO: 25392 - protein, 47 aa, synthetic construct
GKGGGGSGGGGSGGGGSFVGQHLCGSHLVEALYLVCGKRGFFYTPRT

SEQ ID NO: 25393 - protein, 34 aa, synthetic construct
KGSHKFVDQHLCGSHLVEALYLVCGKRGFFYTPR

SEQ ID NO: 25394 - protein, 31 aa, synthetic construct
KFVDQHLCGSHLVEALYLVCGKRGFFYTPKT

SEQ ID NO: 25395 - protein, 45 aa, synthetic construct
KGGGGSGGGGSGGGGSFVNQHLCGSHLVEALYLVCGERGFFYTPK

SEQ ID NO: 25396 - protein, 36 aa, synthetic construct
GKGSHKFVNQHLCGSHLVEALYLVCGKRGFFYTRPT

SEQ ID NO: 25397 - protein, 46 aa, synthetic construct
GKGGGGSGGGGSGGGGSFVNQHLCGSHLVEALYLVCGERGFFYTPK
